United States Patent 8,765,408 (PROPHAGE ELEMENT-FREE BACTERIA) - sequence listing, part 3

SEQ ID NO: 1 - DNA, 4639675 bp, Escherichia coli (residues 3,093,119-4,639,675 of 4,639,675)
aatgaacgatattgcgcataacctggcacaggtccgggacaaaatctcagcggctgcaacgcgttgcggccgttctccagaagaaattacgctgcttgcagtcagtaaaacaaaacctgcgagcgccatcgcagaagccattgatgccgggcagcgtcaatttggtgaaaactacgttcaggaaggggtagataaaattcgccactttcaggaactgggcgtaacaggattagaatggcattttattggcccgttgcagtctaataaaagccgcctggtggcagagcatttcgactggtgtcataccatcgaccgtttgcgcatcgctacccgtctcaacgaccagcgcccggcagaacttccccctcttaacgttctgattcaaattaacattagtgatgaaaacagtaagtccgggattcaactggctgaactggacgagctggcagctgcggtcgctgaactaccgcgtttacgtctgcgcgggttgatggcaatccctgcgcctgagtcagaatatgtaaggcagtttgaagttgcacgccaaatggctgtagcatttgccggactgaaaacgcgctacccgcatatcgacacgctctctctgggaatgtcggacgatatggaagccgccattgcggcaggtagcacgatggttcgtatcggcactgcaatttttggtgcgcgtgattactctaaaaaataaggaattaaaggaacgccatgaatacgttgactttcctgctttcaacggtcattgagctgtataccatggtgctgttattacgcatctggatgcagtgggctcattgtgatttttacaaccccttctcacagtttgtagtgaaggtaacgcagccaattatcgggccactgcgccgcgttattccggcaatggggccaattgacagcgcctcgctgctggttgcctatattctcagttttatcaaagccatcgtgctgtttaaagtggtgaccttcctgccaatcatctggattgccggtttactgattctgctgaaaaccatcggcctgctgattttctgggtcctgctggtgatggcgattatgagctgggtaagccaggggcgtagcccgattgaatacgtgctgattcagctggccgatccgctgctgcgcccgattcgccgcctgctaccggcaatgggtgggattgatttctcgccgatgatcctcgttctgctgctgtatgtcatcaatatgggtgtcgcagaagtattacaggcaaccggaaatatgctgctgccagggctgtggatggcgttatgaatgccgtaacagttaatgatgacggtctggttttacggctctatattcagccgaaagccagccgtgattctattgtcggtttacatggcgacgaagttaaagtcgccattaccgcgccgccggttgacggccaggccaacagtcatctggtgaagtttctcggtaagcaattccgggttgccaaaagccaggtggtgattgaaaaaggcgaacttggccgccacaaacaaattaaaatcattaatccgcaacaaatcccgccagaaatcgcggcgttaattaattaggtatcctatgcaaaaagttgtcctcgcaaccggcaatgtcggtaaagtgcgtgagctggcgtcgctgcttagcgacttcggtcttgatatcgtggcccaaacagacctcggcgttgattccgctgaagaaaccggcctgacctttatcgaaaacgcgattctgaaagcgcgccatgcggcaaaagtgaccgctttaccggcaattgccgacgactctggtctggcggtagatgtgcttggcggcgcgccgggcatttactccgcgcgttattccggtgaagacgcgaccgatcaaaagaatctgcaaaaactgctggaaacaatgaaagacgtaccggacgaccaacgtcaggcgcgtttccactgcgtgctggtatatctgcgtcacgcggaagatcccactccgctggtatgccacggtagctggccgggcgtgattactcgtgaaccagcgggcactggtggctttggttatgatccaatcttcttcgtaccttccgaagggaaaaccgccgccgaactgacccgcgaagaaaagagcgccatttcccaccgtggtcaggcgttgaaactgctgctggacgctttacgtaatggttaaattacctccgctgagtctctacattcacatcccgtggtgcgtgcagaaatgcccgtactgcgatttcaactctcacgcgttgaaaggagaagtgccgcacgacgattatgttcagcatctgcttaacgatctggacaacgatgtggcttacgctcagggccgtgaagtaaagacaatctttattggcggtggtacgccgagcctgctttccggcccggcgatgcaaacgctgctggacggcgtgcgtgcgcgtttgccgctggcagcggatgcagaaattactatggaagcgaaccctggcacggtagaagccgatcgctttgtcgattatcagcgtgctggtgtgaaccgcatctctattggtgtgcagagttttagcgaagaaaagctgaaacgacttgggcgtattcatggcccgcaagaagcgaaacgcgcggcgaagctggcgagcggtttagggttacgtagctttaaccttgatttgatgcatgggctgccggatcaatcactggaagaggcgcttggcgatctacgccaggccattgaactgaatccgccgcatctttcctggtatcaactgaccatcgaacccaatacgctgtttggttcgcgaccaccggtgctgccggacgatgacgcgttgtgggatatattcgaacaggggcatcagttattaaccgcagcgggttatcagcaatatgaaacttccgcttacgccaaacccggttatcagtgccagcacaatctcaactactggcgctttggtgactacatcggtattggctgcggcgcacacggcaaagtgaccttcccggatgggcgcattctgcgtaccaccaaaacgcgtcatccgcgtggttttatgcaaggaaggtatctggaaagccagcgtgatgtcgaagccacagataagccgtttgagttctttatgaatcgcttccgtctgctggaggccgcgccgcgcgtggagtttattgcgtataccgggctttgcgaagatgtgattcgcccacagttagacgaggcgattgcccagggttatctcaccgaatgtgcggattactggcagataacggaacatgggaagctgtttttaaattcgctgctggagctttttctggctgagtaaacttgtattgccggatgcggcgtgaacgccttatccagccgacatgtggcagcggttgtaggtctgataagacgcgcaagcgtcgcatcagacgttgattgccggatgcggggtcaacgccgcatcctgctacaaatcgtgcactatatcaaacttacttaatcaccccattgcgccgcagttgttcggtatcttttttccagcgttcattagcttggttgatatcgtcaattttcatcaaaatcgcgacttttttactgtttatttctgaaactttcatcgttaacggatattgccctttttcgagcgttacccagtcatcctgcaatttacggctaagtttttgtgattgcagaaaagtctgtcgccgttgttcgttgatatcgaaatctcgtttctgctgaatcggcacttcataacactcttcactctgtttatgacatgccgcaatcgccggttgataaacctctttgtcatatttaaccgcgaacgcctcgctatcgttctgtttattaaactcatcacgctgttggtgaatttttttaaaggcgtcttcgcgggtcatttgcttaccgtttgcatcttttccccaatatgcatccgctgctttctgcgccgccaccatttgcttatcaagcgctttcacttccttttccagcgcaggaatcgagttcttctgggtattcaacgcagattcaagctgactaaagcgataattgaaatcttcgctattcacgatcagatatttattattcgttttgatatcgtcgaccacccgcccacgatcgctggctgccgcctgaaaagagtaaaagttcaccgaccagccagacgcgggcgttcctttactggttaacatcgccgagaattttaccggtttatctttcgtccaggtctgttcgagcagttcgtaatctgccaactgaccgacccaggtatagagatcgtcactggaagagacatcgccttccgctgaccaggtggcctgattacccttagcatcaagattttttaaggtgatagcatcaagcttgagaatgccgtgatactgctttttgaattgatcttttaagatattttcagttggcggttcgccatctgcccaggcattaccagtcatcaacataagcagtgccgtgccaacaatccattgctttttcacccgaaaaacctcacgcggaataatttattccggtgattatcattagggtaattaaaattggcaatggacgtgagtctgaagtgaaaaagccccggcacgataccggggcgaggcgattagtactgattgaagatctgctggatctgctgcggatctttggtttgcgtcagagccagttgcagcagaacgcgcgctttttgcgggttcagcgtgccagaggcgacgaagccgtatttcgcatcatccacttcggcatcctgagtggtagcgcccgtcggtacgcgggaagaacgcacgactgcagtaccggttttcgcggcggtcgccagcgtgtcgaacacagatttatacaggttgccgttacccacaccagcgctaacgatgccatcatagcccgcatctaccagtgctttagccggaagatcggatgcgttagcgtagttataaacaatgccgactttcggcagttcattcagcttagagacatcgaatggcgtgtcgctggtatgcttacgtgccggggtacgctggtagtcaatcttaccgttgtgaatgtaacccagaggaccgtagttaacagacttgaaggtcgctacgtcggtggtgttggttttggtgacgtcacggccatcaagcacggtgtcattcatcactaccagcacgccacggttggcggaggctttatcagctgcggtcactaccgcgttatacaggttgaatggaccgtctgcgctcatagacgtggacggacgcattgcgccgaccatcaccaccggtttgtcgcatttcaccgtcaggtcgaggaagtaagcagtttcttccatcgtgtcggtaccgtgggtaatgacgaagccgtcggtcttatcgcagtcggtgttaatttttttcgccagtgtcagccagacattatcgttcatgtcctgggagccgatattcactacctgctcgcctttaacgttcgcaatgtcttttagttgcggcaccgcattaaccagattttctacgccaactttacccactgtgtagttagatttggttgcggagtcaccaccaccggcaatggtcccgccggttgctaaaatggtgatattgggtaatgccaatgctgcaccactaaaacccataaccagtgcggcaagtgccgtctttttgaaaaactccatttcattcctccagttacgtgaacgctacgcattatcccttagctctgtatgggaaatttgacgttaaacaatttacaacgtgaatatattttggagatctacaaagttagaggcaggtaacaaaacgaagaattaaacggcataaaaaagtattatgccgtcttaaaatagaggattattttaaattcccgaccagggctttgcggctatcttccagagtcacaacgcggctacaaacatctttgccaaactgctggaaatctttttcctgctttttccactcggtttggattgaggattgcagcccccccaggcttcccagcacattctgtaatgggttaccgccgcttttcagcaccgctttcgcgcccatttcattaatgctgtcctgtaaaattccacccattgcctgattcactaattgctggccttcggcgcgaacctgatcaatggctttatagtgaaacgtcaggccatcgctgcgcgtttcaataatgcggttcatctgctctttcagctgcgcatcaagtttggtcagacggctgcgcattttgctgctttcgcccatctcctgaacgataattttatccagagcaatacgggctttctcgacgcggcttttcgcgccttcatcaatccacggcagcgtgctgcgtagttcagcctgataatccttcgcctgctcgcgctgggcggcattcagggaatattgcttaccgttatacatcacgttgccgtctggcgtgatcaccagattgccgttttcgcccttcacctgcacggtttgcgggctgacaatcacatcgtcacgcggcgtgacgctgcactggtagtcggcgtgagcggtcattgccgtcactgaaagtgctgccgccagcagcattttgcgcatcatagtcttccctcaagaaaaaatcaggccagcatttgctggccccagattgataacaaagtacgcgttttccatgccggatgcggcgtaaacaccttatcccgcctactcgatcgtgcatctttccaggcctgataagcgtagcgcatcaggcagttttgcatttgtcatcgcccgtatgctttcttagtcccaccaaacgtcgaaaagttcgctggtgcgtacctcatccagtttgcgctcttccagccacttacgcacaatcgcctgatgttcttcggtgcatttgccgatttcctgcatgcagatcagaccttcccaggccagataaccgctgccgtcaaaggccagtttgttcggttcgataacctcgttaataaaatcatcaacggttttatcaatctgttcttccgatgtaccttccgggaatcgccatgccaccgaaaatcctaattcctggaattcgtcgatgtgcatttttttacgcagacgacggctacggttctttgccattatttcaccctctcgaacattaagtcccatactccgtgaccaagacgatgaccacgttgttcaaatttcgtcaccggacgtgatgccggacgcggtacgtaatcattgctctctgacaggtttttataaccgtcaatagaagacatcacttcaagcatatgttccgcataaggttcccagtcggtcgccatatggaatacgccccccagctgcagtttgctttttaccagttcggcaaacggcacctgaacgatacggcgtttattatggcgcgctttgtgccacgggtcagggaaaaagagctgcaccatgcgcaatgaattgtcaggaatcattttatgcagcacttcaaccgcatcgtgacacatcacgcgcaggttgcttaaaccttcttcatgcgcagaagccaggcacgcaccaacgcccggtgaatgcacttcaatgccgaggaagtcctgctcagggcgatctttagccattgccaccagcgacgcccccatgccaaaaccaatctcaagcgtcaccggcgcttcacggccaaaaagcgcggggaaatccagcatatcttcgctgaactcaacgcccatcaccggccagtagttttccagcgcatgttcctggcctttggtcagtcgcccctggcggcgcacaaaactacggatacggcgcagtgggcggccgttttcatcaaattccggtgaaatgacgtcgtttttcataaaggtttagtcgcttgtgaaagtgttctgaaaacgggcattatccaaagttagttgccggatgcaagcatgataaggccgtggctgcggaaagttccggtttacaccctgccgtcgctgtgctgcaatcttgcccccaacaacagtgaattcggtgaccatgcaagcgtcgcaattttcagcccaggttctggactggtacgataaatacgggcgaaaaactctgccctggcaaattgacaagacgccctacaaagtatggctctcagaagtgatgttgcaacaaactcaggttgcgaccgttatcccctattttgaacgctttatggcgcgcttcccgacggtgaccgatctcgccaatgcgccgctcgacgaagttctccacttgtggaccgggcttggctattacgcccgcgcgcgcaatctgcataaagcggcacaacaagtggcgaccttacacggcggtaaattcccggaaacctttgaggaagttgcagcactgccgggcgtcgggcgttccaccgcaggcgcgattctctcgctttctctgggtaagcactttccgattctcgacggtaacgtcaaacgcgtgctggcgcgctgctatgctgtaagcggctggcctgggaaaaaagaggtcgagaataaattatggagtttgagcgagcaggtgacgcccgcggttggcgtggaacggtttaatcaggcgatgatggatttgggtgcgatgatttgtacgcgctcgaaaccgaaatgttcgctctgtccgctacaaaacggatgtattgccgccgccaacaatagctgggcgctttatccgggcaaaaaaccgaaacagacgctgccggagcgcaccggctactttttgctattacagcacgaagatgaagtattgctggcgcagcgtccgccgagcggattgtggggcggtttatactgtttcccgcagtttgccgacgaagaaagtttgcggcagtggctggcgcaacggcagattgctgccgataacctgacgcaactgaccgcgtttcggcataccttcagccatttccacttagatattgtgcctatgtggcttcccgtgtcgtcattcaccggctgcatggatgaaggcaatgcgctctggtataacttagcgcaaccgccgtcagttggcctagcggctcccgtggagcgtttgttacagcagttacgcactggcgcgccggtttagcgcgtgagtcgataaagaggatgatttatgagcagaacgattttttgtactttcctgcaacgtgaagcagaaggtcaggattttcagctgtaccccggcgagctgggaaaacgcatctataacgagatctccaaagaagcctgggcgcagtggcagcacaagcaaaccatgctgattaatgaaaagaaactcaacatgatgaatgccgagcaccgcaagctgcttgagcaggagatggtcaacttcctgttcgagggtaaagaggtgcatatcgagggctatacgccggaagataaaaaataaaaacagtgccggagcacgcctccggcaacttgcataaaaacaaacacaacacgcacccggaatgatgaaaaaatatctcgcgctggctttgattgcgccgttgctcatctcctgttcgacgaccaaaaaaggcgatacctataacgaagcctgggtcaaagataccaacggttttgatattctgatggggcaatttgcccacaatattgagaacatctggggcttcaaagaggtggtgatcgctggtcctaaggactacgtgaaatacaccgatcaatatcagacccgcagccacatcaacttcgatgacggtacgattactatcgaaaccatcgccgggacagaacctgccgcgcatttgcgccgggcaattatcaaaacgttattgatgggtgacgatccgagttcggtcgatctctattccgacgttgatgatattacgatttcgaaagaacctttcctttacggtcaggtggtggacaacaccgggcagccgattcgctgggaaggtcgcgcaagcaacttcgcggattatctgctgaaaaaccgtctgaagagccgcagcaacgggctgcgtatcatctacagcgtcaccattaacatggtgccgaaccaccttgataaacgtgcgcacaaatatctcggcatggtccgccaggcgtcacggaaatatggcgttgatgagtcgctgattctggcaattatgcagaccgaatcttcctttaacccgtatgcggtcagccgttccgatgcgctgggattaatgcaggtggtacaacatactgccgggaaagatgtgttccgctcgcaggggaaatccggcacgccgagccgcagtttcttgtttgatcctgccagcaatattgataccggcaccgcgtatctggcgatgctgaacaatgtttatctcggcggaattgataacccaacatcgcggcgttatgccgtcatcaccgcctataacggcggcgcaggcagcgtgctgcgagtcttttcgaatgataagattcaggctgccaatattattaacaccatgacgccgggcgatgtttatcagacgctgacgacccgccatccctctgcggaatctcgccgttatctttataaagtgaataccgcgcaaaaatcctaccgccgccgataattccattaaccgcccctgacgatgctcaggggcaaaaatgttatccacatcacaatttcgttttgcaaattgggaatgtttgcaattatttgccacaggtaacaaaaaaccagtccgcgaagttgatagaatcccatcatctcgcacggtcaaatgtgctttttcaaacactcatccgcatcacgatgtgaggaaattaacatgaatcttaagctgcagctgaaaatcctctcttttctgcagttctgtctgtggggaagttggctgacgaccctcggctcctatatgtttgttaccctgaagtttgacggtgcttctattggcgcagtttatagctcactgggtatcgcagcggtctttatgcctgcgctgctggggattgtggccgacaaatggttaagtgcgaaatgggtatatgccatttgccacaccattggcgctatcacgctgttcatggcggcacaggtcacgacaccggaagcgatgttccttgtgatattgattaactcgtttgcttatatgccaacgcttgggttaatcaacaccatctcttactatcgcctgcaaaatgccgggatggatatcgttactgacttcccgccaatccgtatctggggcaccatcggctttatcatggcaatgtgggtggtgagcctgtctggcttcgaattaagccacatgcagctgtatattggcgcagcactttccgccattctggttctgtttaccctgactctgccgcatattccggttgctaaacagcaagcgaatcagagctggacaaccctgctgggcctcgatgcattcgcgctgtttaaaaacaagcgtatggcaatcttctttatcttctcaatgctgctgggcgcggaactgcagattaccaacatgttcggtaataccttcctgcacagcttcgacaaagatccgatgtttgccagcagctttattgtgcagcatgcgtcaatcatcatgtcgatttcgcagatctctgaaaccctgttcattctgaccatcccgttcttcttaagccgctacggtattaagaacgtaatgatgatcagtattgtggcgtggatcctgcgttttgcgctgtttgcttacggcgacccgactccgttcggtactgtactgctggtactgtcgatgatcgtttacggttgcgcattcgacttcttcaacatctctggttcggtgtttgtcgaaaaagaagttagcccggcaattcgcgccagtgcacaagggatgttcctgatgatgactaacggcttcggctgtatcctcggcggcatcgtgagcggtaaagttgttgagatgtacacccaaaacggcattaccgactggcagaccgtatggttgattttcgctggttactccgtggttctggccttcgcgttcatggcgatgttcaaatataaacacgttcgtgtcccgacaggcacacagacggttagccactaattacgcaaagaaaaacgggtcgccagaaggtgacccgttttttttattcttacttcaacacataaccgtacaaccgtttcacgccatccgcatcggtttcgctataaacaccttgcagctccggcgaaaatcccggcaacaaattcaccccttcttccagtgcaaggaaataacgttgaaccgccccaccccagacttccccgggtaccacgcaaagcacgccaggtggataaggcaacgccccttctgccgcaattcgcccttcggcatcacgaatccgcaccaactccacgtcaccgcgaatataagcgctatgcgcatcctgggggttcatcaccactgacgggaaactctgctggcggaacatcgctttttgtaggtctttgacgtcgaaactgacatacagatcgtgcatctcctgacacaactggcgcagggtgtagtcgcgatagcgcaccggatacttgttataaacgctcggcaacacctcaaccagcggcgagtcatcctcaatatgctgttcaaattgcgccagcatcgccaccagttgtgccagcttctcgtggctttccgccggagttaataaaaacagaatggagttgagatcgcacttctccggcacaatgccgttctcacgcagatagtgcgccagaatcgtcgccggaacgccaaagtcgctatattcgccggtttcggcatcgatacctggtgtagtgagtaacagcttgcacggatcaacaaaatactgatccgcggcatatccttcaaagccgtgccacttcgcccccggctcaaaactgaaaaaacggcggtcgctggctaacactgatgtcggataatcctgccacaatttgccatcaacaacgggcgggataaacgggcggaacagcttacagcgcgcaagaatagccttgcgcgcttcaatccctatctcaacacactcagcccacagccgacgcccactctccccttcatgaattttggcgttaacatccagtgcagcaaacagcggatagaaagggctggtagaagcatggagcataaaggcgttattcaaccgcttatgcgggcaaaaacgcgcctgtccgcggatatggttatcttttttatggatctgcgacgtctgtgagaatcccgcctgctgtttgtgcaccgactgagtcacaaagatccccggatcgttttcgttaagttctaacagcagcggcgagctatccgccatcatcgggataaattgttcataaccgacccacgcggaatcaaacagaatgtaatcacacagatgcccaacggtatcgatcacctgacgggcgttatagacagtgccgtcataggttcccagctgaataatcgccaggcgatacgggcgcggcaggtcggctttttctggcgcaacgtcgcgaatttgctggcgcagatactcttcattaaaacagtgcgcatcaataccgccaatgaaaccaaacgggttgcgtgaagcttccagatagaccggcgtcgcccccgcctgaatcagcgcgccgtgatgattcgacttatggttgttacggtcgaagagcaccagatcgccacgcgttaacagcgcattcgtcaccactttattcgctgccgatgtgccgttcagcacaaaataggttttatcggcatgaaagactttggctgcgaatttctgcgcatctttcgccgatccttcatgaataagcagatcgcccaattttacgtcagcgttacacatatcggcgcgaaagacgttctcaccaaagaaatcgtaaaaatggcgtccggcaggatgctttttaaaaaacgcaccatgttgatgtccagggcaagcaaaggtgctgttgcccatctcaacgtactgcgtcagcgtgtcataaaacggtggcagcaaattctcttcatactgacaggctgcggattccagctccagccactgctgctcgttgccgttgattaccgccgtaacgcccgcaggtaattcaacagcatgttcggaatacaaaaacaccggtagatgaaaaccggtgcgcttaagcaacgcaagaatgccactgcgactatccgcagcggtaatgacgactgccgcgacgtccgtaaaatcagtatctcccaacgccaccacgcgacgatgagaagaaagtcgggataccagttcactactggcggcaatattcattgatttcataagcgcaaacccgtttcggggaagtaagaataccggacaaggtggaaaaccctgccccatgagatatgggtcaaactggtcaccagctccgaccgccagacatcagtaaaagcagaaacgctctgattttactgttgtcctgcagtgagcgtgcgttaacttcaccgcatgagcagtaacatagaaagggaaacgtttcgcgcgaaacggcgataagcgagagaatgtaaggagatggcgtgcatcgggcaaactccgtacagagaggagaaaattcgcgcaatcatggcacctttcgctaaagcgtgcaagccaggactttgcgaacaaacaagccatcgacggcaccaaacggtcataataagaaaatcaaacaatacagctaacaggaactcttgtggtcatcggcccttttatcaacgctagtgcagtcttactgggtggcgttctcggcgcactgctcagccaacgcttaccggaacgtatccgcgtctccatgacatcaatttttggtctggcatcgctggggattggtattttactggtggtgaaatgtgccaaccttccagcgatggttttagctacgctacttggcgctctaattggcgaaatttgtttgctggagaaaggtgtcaatacagcagtcgccaaagcacaaaatctgtttcgtcactcacgtaagaagccagcgcatgaatcttttattcagaattatgtcgcgattattgtcctgttttgcgccagcggcaccgggatcttcggggcgatgaacgaagggatgaccggcgatccgagtattttaatcgccaagtcatttcttgatttctttacggcgatgatcttcgcctgctcgctgggtattgcggtatcggtgattagtatcccattactgatcatccagttaacgctggcgtgggctgccgcgctgattttaccgctgaccacaccgtcgatgatggcagacttcagcgccgtaggcggtttattgctgctggcaaccggattacgcatctgtggcattaaaatgttcccggtggtcaacatgcttccagcactccttctggcaatgccgctttccgccgcctggaccgcctggtttgcctgacaatgcgtgcaatatcggcaaagtgatgatagattgtgcagtctgcagtaaattgaagaaatttgattgacgagacgaggcgaatcaggtttaatgcgccccgttgcccggatagctcagtcggtagagcaggggattgaaaatccccgtgtccttggttcgattccgagtccgggcaccactaattcttaagaacccgcccacaaggcgggtttttgcttttggatctgacaataaccttcacgaaaaaaattagcttataaagtctgggggaattactctcgccacgttaacgagagtaattttattgatattaatctcctgatactttacccccgtccaaactccagccgctgcacattcaccatcccaggcttctcagcagcactgacatcaatttgtgtcacccgcagcgcatatttttcatccagtgcgtttaaccatttcagcaggtcattaaacaccacaggttctatccagacctgaatattctccccacgatcggctatccgcctgatgaccaccgagtgcgcggaagcactgtcactgatgacccgcgatacctgcgcaggcgttgttgtggcagattttcgcgctgcaataatatccggcgcggcgttcttcagtcgggtgttcatcgccaccagctgctgcaatattgtctcctgttgctcaatccgttcgctcaacggctgccagatgaggacgtaatatccgacgctaaacaggaacaccaccgctgccagtaacatgcccttttcacgcggagaacgccccgccaggtgttgtgccagccagtgttcgccacggcttaactggcgttcacgccattgctgaaaatagtgaataaatttatcgcgtaacatgttatttcctccgcaacgttacgccgccggaaaccgcatcaccctctttctgtaacgcgtcctgttgcacaacataatcggttgccagtacactacgcagtttgtcgaaactggcaaagttcgcggcccgtagctggaggtgaagtatctggcgtttttgatcaaaggtaaaaccacgcatttcgatgtcggaaagtgacgctgatttcagggtgctggctatcgctgacaactcggcgagcagccgggtatcgtcggcctgtgggcgatattttttcagcgccatcgtcacctgagagcgtaaattcacaatccgcttctgctccgggaacaacgttaagaactgttcctccgcctgggtgcggctttgcgccacctgttcgctgacgctccataacgtcacgccccgctccactgccagcgcaaccagaatcagcaatatcggcagaatcatcacccgccagcgcgcccactgttttcggtagctgacgcgaggctgccacggccctgtcagcaggttcccttccggttcgccataagtggtaatggcgggcagagctgtaacggtcaggcgttcagcgtctgcgccagcccatgctgatagcttttccggtgcaatgccgactacggttagcgaaagcggtaaatcctgctcattgagctgggcgcggaacatgaccggagccagcgccagcccggcgctccatccccggcattcatcgatgcggcagataacccgttgcgcatcgcaagccataaacccacaaggaatggacatccagtccggcgcgacggtagcgcgggtgatgccgttttcctgcaaccactgcgcaatgttgcgcatatgctgttggtgaatcactgctacggttgccagttgctggtcgatattcaacggggcgaaatgcagttcatcgatatcctggttcagctcttcttccagtaaggcgggcagaatagtcggtagcgcagcgcgatggaaatgtcgtggcgcgcacccttgcgtaaaaccgtaagttgaatggaatccattgaaggtaactgccgcatcagagcaatcattgctcgtggatcagtgaaatcctgctgatttagcgcaatggcgatatcgccttccttgaaaccgctggcatcgaacagagaacgatctgcccccggcttcgctgcataaccgacaatcccctccttacgcacaggcgtaagctggatatagttaaaaattttctgcggatctttcgccagtgcctgacgcacggcagccgggatctcaactggcacactgacagcaggctcagcaacagcttgctttgcttcgtcactgacggcttttttgttggtcacagcaacagtggaacgttcctcttctgccagactcagacgctctatttttccctgataacgcagcatcacatggtcgcggttgatttcctcaatcaccgcgttgtgagagccaagcgtttcaccctgcaaatagacctgctgtttaccgccttcttcaataaccgcgccgggtctggcaccaaaggcgatcccacgcagcaccacattaagacgcgtttctgccacaggcacaggttcgggttgttttacctgcgcggcgacaggctgatatttgccaaaccagttttgctggctgattaattgcacgtcatttttatcgaacgtttttgcatccacacggctcggtttattcaccggttgagaaaccgccgtatattccgcagaaaaggagatatagcgccagagtgaatgcgccatttttgcagaaataataagcagcatcagccagaacatcccgcgtgcaatttttcgcagatgctctttgtctgtattaagagattgtctctggttaagagtgtgacgaatttttgtcagccattgaatgagataaattcgtgcgtcacgaaaaacaacccgcgccaatttatatctacccgacgttatgctttgactattccacaggtggtacgatccagtttccgctgatactggttacctgtacgtgtatcattaatcgttatgctgtaattaattccctcagtgatcattaatttcaccgtcgggtcagcgcacatttgtcgttgatagctggttaaaaaggcgtcaggcgtctgcgtggtttgtgtacccgcttcgctgataatggtcatttttaccgttgtgccgctactttgcgccagcactaaggtatatcccgcagatttaatcggcaggttttggctgatattttgcgcctgttttttcgccagtaaactggcattttcattatggctggcacagccacttaataatcctgtaacgctcaacaatagcgatattaataccctccctggcatttgttttatcgacatggtaaataatctctaaggttattaataagagttaaaatgtcactttgataatgacgtggttatcattaaaacaatgcctgtagataaagtgttgctataccgcccagacttaaacacggtccaaaaggcagtgtggttgatcctctttttgtaataacggcatatatcaggccgcagcatgaggcgattaaagcaacattgggcagcgacaatgcccccacccagccacctaacgcggcgaaaagtaatacatcgcccatgcctaatgcttctttacgcagaactattccggctatccaacgcagagagtaaaaagtgataaatcccaccaggacgccggtgactgcatcttgtagcgtgagcggactctgctgcgcccatgccgcaatcagtcctgtccacaatacgccctgagtaaaaacatcgggcagccattggtgatcgaggtcgatgacactcgcggcaatcagccaggcggataatatcatcaccgccagcccccatccactttctggccagaccagactcgccagcaaaaaagcaagtgctgtcaataactccaccagcggataacgcttgctgattttcgcctgacagtcgcggcagcgccctttgagcatcagccaggagaacagcggaatattgtcacgtatccggatggtctgctgacaatgtgggcagtgcgaacgcggtagcgcaaggcttatttttgactgcgcactcgacatttcaccgtgaaactccgccatttgttggcgcagcatgattgggtaacgccaaatcaccacattcaaaaaactgccgatgatcaatcctccgacggttgccaggacgggcatcgccgtggggtattgctgaaaaacatcaaaaagcatggttaaaggttgtttgttgtaacttgctggatgcggcgtaaaacgccttatccgtcctacgggtgtctgccagcgcaaataatcgcggctttccccgtctgtaggcccgataagcaggcgcatcgggcaaatgtgttaacccggtgcgccttatttcatgccggatgcggcgcgagcgccttatccggcctacgggcttactcggcagacatcttatgctcggtaacctgattaatggtttccggtccctgttccggtttcggcagatcgagtgacgcgagcgtgttgtaagccgactggctcacaccgccctcgaagctcatctcgctcgcccccggcagctggtaagcattcgcgcccggattccatttcttaaagaactccgaaagatccgtctgggcgacccaggaggcacacagcatcagcgtgtccgctgcgttaccgttggattcagcacagtaattcttgccgccaaacttgtcattgctgacctcatcgccgcgtgctttacgatgcatcaactggaacaggttccagcctttcatcccttcacgctcgctgtaaaactctggcagaggagtgccatctggataccatttcttgatatcaaagtttttctctgcccattccttcagctgtgcgtacatcagcagacggtcacccgcaccgccgcgtgcccatgcctggttgttgctctcctccagatattccggtgcgacggtaatatcgtcagcgacacggttcatcttgccgagataacgatcctgcatgtacagcgccagcacgttgttagcgacttcagttgcacccggtacagtcaacggcgtttctgcggcgttatgaccgacttcatgccagatcagccagtcgttcagcggcgtcgtcggcagcgtggtgctgttcggcgagaagctgctgttcattaccggataacccgaatgcgcatcaccgatggagatctgcacatcgttggtgaaacgatgtttgtggcccggcaagtttttataggtaaacatccggtgcttaccgtcttcgctatcacggccgtagaagtcattcatcgagctggcaaaggtatccagatcgttagcgaattgctccagtccgccagtgtaattgctggcattcaggttcttcttcggtgtggtatagacgaaagcgtctgattccagctcacccagcggagccggtgagttcagatcgtttttccatgcgccgtctttatagaacggtgcttttaccacgccagtaaaggtgaagctggcagattcattggtagagctattgcccttgatataaatcaggccaccgtaaggcaccttgaacttcaccgtaccgctagcgtccagagagtacgttttagtcactcttggcggacggttcagcgcaacttcatgcttctcacgtccggtcaggtcgtcagccagcgccacggtgacggtcacaggaacgttcgcattggacttaatggtgacctctttctgagccggtgcccacaggccagttgactgcatgttacctgcaaaccatttggtcggattcgagtacaggctgatggtttcagtaacgttctgtccctcttccgatactgctcccggatacttctcgacatcaactttgatgttcagatcccaccaggaacggcccagcatcaggcgtgtcagcggtttttccatatagttgagcgggtagctcgggttcatcatgcccgctttgctgctaccgtcaccgtagatcatgttgttatcgaccagcgattttttcagatctgcagaacacttggtgccgcctgcataggcatcattggcgtagcagttcaggaactcggtgaacgttttaaagcccagctcgtcatttttgccttcttcataacgatagctcgtatcgttccacagccagaccgacatgttctggtacagacgttccagatcgacgctgctcagacgctcacctttgcgaccattggtccggaagtagagctcatgctgatacagacgctgaatgttggtgcctaaatccgcagcctgcaccatcgcttttgcagtgtcggcgttaaggcttagttgcgtatactgtggaacatacatgccaccagtaaccggaacccccgtgccaggacgatattccaggcagttgacctcatagtgatatgccggattagtacactctttcagccccgggaacgcggcgaaaattttctccttcgcagccttcagagaatcctctgttttatgatcggcctcatcaataaaggcataacgcgtttcctgtttgccatctacatcttccagccagctggcaacttccagcttcggtttgtcatcaggtttgttttctacctgatatttccacttaacttcccctgtcttactatcgatggtgtacggcagcgcaccatctacggcaggataacgttcatagacccaaatgcccgttgcgcgctgctgacgaacgcggttcggatacccttgcggatcgttatttactaccgacttgttcagtgccatcgacagacctgcggcatccaacagacgcacaaaaccagacgcgctctcttccttaagattgctcatcacgttttccatgatcagcaccgatccacctttgttcagataggcgatcagatcggtcacatcctgctgagtcagcttcggtttgctggtatctgcacgcagcgggattgcataaggatcgttacccacctgagtcacatattcaaagccgttaaggatcagcagcggcatttcctgcggatcgagatcgccatagctacttaaatgctcaacagagatgcccgcaaaatccggatggaagtcgaacgcagcgctgtttcctgtaacctgaccatgacgtttaaaatagacagtatccaggttggtgcctacggtcatgctggctttcgcgtccggcttccatttatcgtcggacagatagcgcagcacgttctccatgaagttcttcatgtcatccgggtcgctgttgagcgtacactgcccatctttattaacgcccccgttccagctgtaaccgttcgggcaacgcaaaatgctgttgtagtgtgggttaccgataaccatcagtttgccctcaccgacttgccccagcgaaataaacggcaggttaaaggtggcggtatcgcgcgtaacgttttccggctcaacaagagaaggcgcttccgtaatgtacgccagctcgtttttatcccaggcgcgtttttcgccgaaggccagccagtagtttttatcattacgcgccatcagaatcgggaaggccgcgttggagatattcaccaccgcctgaccgcgcgcattacccgtgctgccatagaagttggtggagtcatggaatacatggaacttgctgacagatttgtagttcgtatccacgccccacagcttgttgataacgccctgaatctggccgtcattaacattgcgcgtcgtcagcgagaaccagcgagcctcgttacaaccatcggttttcgcacaaatcgcggtatcgatctctttggcctgacccgtattaaactgctcaataaattcgttaggcagattaacgacttgctcaccttcccccagcgtcgcaccgttggataacgagagattgataatctcgttgatcacgttgggatattcggcaaagaccttgcgtacatcgtccggaacaacacgggtattattttgcccggtcgtcgaatagcgatgaataagctgatcaatattcgccccgcgaacttcatcacccagttcagtcagcgcaatggtcgacttattgccgcgcactgaacccagttcaaaggtatcgataccaaaggagatggtttcgccccagctaaaggaaaattcaccattttcccctgtcacgccacggcctgaattggtgtagtagttgacgccagcaacaccatatccctggctatcgaccagtcgaccttcagagagaatgatttcagtgggttgatactgataaaactgttccgcgttagccgacacgaaggaagcgttcagatccggttttgttcccggcgtggtgacgggcacgaccggtgaagtatgagtggatggcgctttatcggtcgcagcattgttttccacctcttcattgaccagctttttgaactcttccggtgccagatcgatttgcttatacagcgagtcgaagcgtttactctcgatcaccgaggagaacgtcagacaaacctgttctgtattcgccggacagctgttactggacgttaccagcgaaaccgcattgcttttcttgtcatcggagcccgccagttcttgcgcgtcctcaaggctaaacgacactttttcaaccgcacgcaagctacgcgcagcttctgactgagtgttgaaggtggcaattgtcgtgttacccgccacgcaagtaacgtcctcgccaggtttaaatgtaaagccatcgctggattcaccattacaggtagcaccagttacccgctggcttccgcccagggtcagataacccgttttcgtaggaacaggttctggctccggttctggtgttggttcaggatcaggtatcggttctggcgtaggctctgggtccggcgttggctcaggcgtcggctccgggtttggtgttggatcaggtttcacttccggcaaagaccctgttccagaatctacaggcggcgtatcggaggaagatccggaaccaccgccatcacaaccggctaacagggttgcgctcaaaatagccgctaaaagcgatttcttatatttaaatttcttattcattaataacgcaagtgacaaaacaatgttaaaaaattcgtaactgggagaaatagttttatgctttatcttctctaataacttcctccattcttaagaaaacgacatcattgatagaaaacaggtgaaatttataagaataacccctatacgatgtctatctggctatttttacgaaatttcaacaaacaaaaaattaacaacatttcacaacgtaactatataaatttgttggtagttttaacgattaagattgcaaaagcaacagatagaacggtgtttgctcatcaagcgaacataattaatacagacttgttttgcgtgataaaaaaatagatgttctcacgctcttaattatttagcaggttatctgaacgcaaaacattattgctgcatggataataaagcgagaaatgattttcaattaataagacagaataatgtaaatgaagccggatgatattaacgatcatccggctttattgatttacgagactaacatcccggtaaacacatacgcctgcagcagggtgataatgccgataacgctggcaaaaatcagactgtgcttcacggtgtagcggaacagttcagattctcggcccaccatgcccgtcgcggcgcaggccacggcgatagattgcggggagatcatcttgccagttacgccgccgctggtgtttgctgccaccagcagggtgtcagagacgttgatttgctgcgccgtggtcgattgcagtgaaccaaacagggcgttagaggaggtgtccgagccggtaaggaatacgcccagccagccgagaaacggtgagaagaacgggaacatcacgcctgtacctgccagtaccagcgccagcgtggtggacatgccagaatagttggtgacgaaggcgaacgccagcaccatgccaatcgacagtatcggccacttcaagctaattagcgtttcggcaaagacgccaatacctttcttgatccccacaccgaggatgaagatagagataatcgccgcaataaaaatagcggtgccgccagccgagagggggtcgaatttaaacaccgcatccattggcgttggttgggcgacaatgggtgccgctttcaacacttgttgatgcaaatgagggatctggaaattaatcaccagtgaataaaacgcgccgcccggagcaaataacgctttaaacggcttcatggtccagatggtgaccagcaccgttaagattaaaaacggtgaccacgctcgaatgatttgccccagactatattctgaaggcacgggaccgccagaagatggcttatttaccaccatcgcacctgcggattgtcccatgctgattgccgtttcggtatttttcggccgccagactttaaggaataaagcgagtgagacgatactcaccagcgccgaagtaatatccggcagttccggaccaatatagttagaggtaaagaactgagtgacagcgaagcttcccccagcaaccagcgccgctggccacgtctctttcacccctttccagccgtccatcattgctaccagccagaacggcacaagaaccgacaggaacggtaactgacgtcccgccattgcgccaatgtggaacggatcgattcccgttacctgaccggcgaccagaatcggcacgcccaacgcaccaaacgccaccggcgcagtattggcaatcagacacagccccgccgcgtataacggtttgaagcccaggcccaccagcagcgcaccggtaatcgccaccggcgcaccaaagccagccgctccttccagcaacgcaccaaaggagaaaccaatcagtaacacctgcaaacgctgatcgtcggtgatggagataaccgagctgcggataatatcgaactgcccgctggcaacggttaatttatacaggaacaccgccgcgacaataatccacgctattggccataatccataaataaagccatagcccgcagcagcaaatgccatatcaatcggcattttaaaggcgaatattgcaatcaggatagataatataagggttattgctccagcgacatgtcctttcagacgtaataccgcgagtgcaacgaagaagaatattatcgggatcagggcgaccagagcggatagccccagtcctcccatcggcatatacatttgggtccaggtaaccatattgttcagtctcttattatctttatatgcttgatatacttaaggttgtaataagcaaaagaggactgaactgtaaaatataggcgttatactttacagcaacagtacgccgctaacgcaattgctacctctggcataacaagtatatcgggtaagggtttctgttccgcacacgcagacgcagagtatcgttaagatgtccatattgttgttttaggcccgctagtaatgcgctacgggtatttaatattgttaaaccctgataatcgctccggttatttccgggataaatgtactaccgcagttactatcatagccccgacaataaaacttgccggggcttttttgacgctattaatgactttctttttcgcgtaaacgccaggcgtgtaataacggttcggtatagccgtttggctgtttcacgccgaggaagattaaatcgctggcagctttaaaagcacacgagttagcgaaattccccgccatcggacgataagccggatcgccagcgttttgctgatcaaccactttcgccatattctccagcgacgcctgcacctgttctttggtcagaataccgtgacgtaaccagttggcgatatgctggctggagatacgcagcgttgcgcggtcttccatcaacgccacattgtgaatatccggcacttttgaacaaccaatcccctgctccacccagcgcaccacgtaccccagaatcccctgcacgttgttatccagctcttgttggatctcttgcgccgaccagttagcgttttcagcaaccggaatagtcagcagatcgtccagcagcggttcaaattcagcattgaactcggtctgggcaatgttggcttgtacgctctgtacgttggtttggtggtagtgcagcgcatggagcgtagcagcggttggtgacggaacccaggctgtgtttgccccggcacgcagttggtcgcccttctggctgtacatgtctgccatcaggtccggcattgcccacatgcctttaccaatttgcgctttaccgcgcagcccacagaacagaccggaaagcacgttattacgctcgtaggctttgatccaaggcgtcgatttcatctgatttttacgcagcatcgggccagcttccatcaccgaatgcatttcatcgccggtacggtcgaggaaaccggtattgatgaacgccacgcggttgcgcgcctgagcgatacagctacgcaagttcagcgaggtccgacgttcttcatccataatgcccattttcagggtattcggtgccataccgagcattgtctcaatgcgggtaaacagtttgttggcgaacgccacttcctgcggaccgtgcattttcggtttcacaatatagacgctgccagtgcgcgagtttttctgcacttttaaatcatagagggcaatcgcgccagtcatgacgccatcaagaatgccttccgggatttcattgccttcgctgtcccaaatcacaggaatggtcatcaaatgacccacgttgcggataaacagcagcgagcgtccgtgcagagaaatttcagagccatcggcggcggtgtaatgacgatcgtcattcagtttacgcacgatttgccgaccgtttttctccattttctcttgcagagtcccctgcatcaggcccagcaggttgcggtacagcaggattttatcttccgcatcaaccgccgcgaccgaatcttcgcagtcgagaatggtactgatagcagcttcgacgataacatcgttgatgtgcgccggatcgtctttgccaatccgcccattggcatcgatttgcagctcaatatgcaggccgttatttttcagcaaaatgcaggtcggcgcagcggcatcgccacggtaaccgacaaactgtgctggagtacgtaacgtggtttctttaccatttttcaactggatgcgtaattgtttatcaaccaccttaaacgccaccacatcctgatagctgccgttttccagcggtagagattcatcgaggaaacgccgaacccaggcgataacctgctcaccgcgttgcggatcgtagccgctgaccatcgccccttcctgcgggatgatgtcgctgccgtataacgcatcgtacagtgagccccagcgagcgttcgccgcgttcagcgcgtagcgggcgttcattgccggaaccaccagctgcggccccgcctggctggtgatttcgctgtcaatgcccgtggtttccaccgtcacgcgctccggttgcggcaccaggtagcccagttcacgcaggaaagatttataggccgctttatcttttaccggccccggattgctgcgatgccactcatcaagcgctgcctgaatgcgatcgcgttctgccagcaactgacgattttctggtgccagatcatgaacgatctcatcaaaattgcgccagaacgccgcagcgtccagccctgttcccggtaaaacttcttcatccacaaaacgtttaaaattggcgtcaatgcgtaaacggctctgggttatggtttgactcattgtttatctcctcgttttcgcttatttcgccaacaccgctgctgccgctttcgcgacctgcgcatcctgtgctccggttaaaccagaaacgcccacggcaccaataatttgcccatccacaacaaccggtacgccgccttccagcgacgttaataacggcgcagtcacgaacgcggtacgtccgttgttcaccatctcttcatagcccttagtttcacgacgccccagcgcggcggtacgcgctttctcctgggagatataagccgcaatcggcgcgcaatcgtccatgcgacttaacgccagcagatgaccgccgtcatcggcaacagcaatggaaacagaccagttatttttctgcgcctcttcctgacctgcggcaataattgcactcgccatttgctggctaagaatgactttagttttcattttgttattccttttcaagggcttgttctacaatttcaatccagtgacgcacagaggtacgaccggcgctcgccagatgcgtctggcaaccaatgttggcggtgacgatcatttccggtttgccgctttccagcgcattcattttgttatcccgcagctggcgtgccagatcgggatgcgttaacgcatatgttcccgctgaaccgcagcacagatggctgtcgggaacgtccgttaaggtaaatccaagacgaagcaacactttttccacttcgccgttcagcttttgcgcatgttgtagggtacacggacagtggaaggccagctttttatcgccgcgaattgccagtttttccagcggttcctcgcgcagaagttcgactaaatcgaccgccagttcactgacctgacgtgctttatcggcatataacgcatcgtttttcagcatctgcccatactctttgacaaacgcgccgcagccgctggcggtttgcaaaattgcctcggcacctgcttcaatcgcgggccaccaggcatcaatattattgcgcgcccgtgccagccctttctcctgcgcattaagatgatagtccaccgcgccacaacagcctgcttcgttagctggcatgacgctgatccccagacgatccagcactcgcgcagttgccgcgttggtgttgggcgaaagcgtaggctgggcgcagccttccaacattaaaacccgacgcttatggcgcagcggcggacgcggtttagctttcaccgtttcagcaggcagttttgctctgacctgttccggtaaaaacggtcgcagcaccagccctacctgcgtcagcgcacggaagaccgccggacgcggcactacctggcgcaatccttcgcgcagtattcgctccggcagtgggcgtttcactttctgctcgacaatatcacgcccgatatccagcaaattgtgatagcgcacaccagaaggacaggtggtttcacaattacggcaagtgaggcagcgatcgagatgctcctgtgttttaagcgtgacttcgttgccttccagcacctgtttaatcagatagatgcgcccgcgcggcccgtccagttcatcgcccagaagctgataggttgggcaggttgcggtacaaaatccgcagtgaacacaggcgcgcaggatgctgtcggcttccagcgcgcgcgcgttctgccgcatctcttcagttaattgggtttgcatagcctgctcctcaaagttccgcgtacatgcgaccggggttaaacacgccgcaagggtcgagctgctgtttaagctgctggtgatagcggaataaaggagccgatagcggggcaaagccaccatctccggcactaaagcgggtcgcatgaccgccagcgttgcgggcgatgcgatggatttgattgtcctcggctgtcgatttcagccagcgtaacgccccgccccagtcgatcagttgctcgccgggtaaatccatcatcggcgcatcactgggtaatgaaatgcgccataaggtacctggtaacgagaagaacggcagttgttgttcacgcaattgctgccagaactgaccggcaacctcttcgccacccagcagttcacgcgctgcttttaccgatccttcgccgccctcaaggcggatccacaacgcattgtcgaagtaacataagccactaatgggtaatggctggagttgccactcggcgatttcactcatggcttcttgcaggctgatttcccgacgcaggctcagggaggcgcgcggtcgcggtaacactttcattgagatttcagtgagcacgccaagacaaccgtagcttccgaccattaaccgtgagagatcgtatccggcaacgtttttcatcacttcgccaccaaaacgcagatgttttccagcgccggtaatgatgcgcgtgccgaggacaaaatcgcggaccgaaccgctccacgggcgacgcggccccgccagcccgcaggcgaccatcccgccccaggtggcttcttcaccataatgcggcggctcacaggggagcatttgccccgcgctttccagcgccgcttcaattgtcaccagcggcgttccgacacgcgcggttatcaccagctcggtcgggtcgtaattaacaatgccgcgatgacaacgaacatccagcgtttgcccggtgacagggcgacctaaaaaggctttgctattgctgccctgaatcaccagcggcgttttatcgctaatcgcctgattcacctgctccagcagcgcctggctgtaatcacactcgcgtagcatcagaaacgctccagttcagggaaaggtaaatgaccgtgatgcacatgcatggcaccaaattcagcacagcggtgtagcgtgggaatgtttttcccagggttcagcaaaccatcggggtcaaacgccgccttgaccgcatggaaggtcgtgatttcatcgctgttgaactgggcgcacatttgattgattttttctcgcccgatgccatgttcgccactgatgctgccgccaacttcaacgcagagttcgaggatcttcccgcccagctcttccgcgcgggcaaattcaccgggttcgttggcatcgaaaaggattaacgggtgcatgttgccatctccggcatgaaagacgttggcaacacgtaaatcatattgctgcgataaacgggcaatgccttccagtacgccaggcagggcgcgacgcgggatggtgccatccatgcagtagtaatccggggagatacgtcctaccgccgggaacgcatttttgcgaccggcccagaaacgtacgcgctctgcttcgtcctgtgccagacggacgtcagtcgcgcccgctttcaacaagatgtcgttaacccgctcgcagtcttcctgtacgtcagactccacgccgtccagctcgcataacaaaatcgcttcggcgtcgacgggataaccggcatgaataaaatcttccgccgcgcggatcgacaggttatccatcatctccagcccgccggggataatgccattggcgatgatgtcaccaaccgcaagtccggctttttctaccgagtcaaagctggctaacagaacccgcgccacgggcggcttcggcagcagttttaccgtcacttcggtggtcacgccgagcataccttccgatccggtgaacagcgccagcaggtcaaaaccaggtgaatccagcgcgtccgatccaagcgtcagtgcctcgccgtccagcgtttgcacttcaattttcagcaggttatgtacggtcagaccatatttcaggcagtggacgccgccggcattttcagccacattgccgccaatggaacaggcgatttgtgaggaagggtccggtgcgtagtagagattatgcggtgcaacggcctgggagatcgccaggttacgcacgcctggctgcacgcgcgcgcggcgaccaacggggttaatgtcgaggatctctttaaagcgcgccatcaccaacaacacacctttttccagcggcagcgcgccaccagaaagcccggtgcctgcaccacgggtcaccaccggtacacgcaggcgatggcagacagccagaatcgctgtcacctgttccatttgcttaggcagaacaaccagtaatggacgcgtgcgatacgcgctcaacccgtcacactcgtaaggaatgatctcctcatcggtatgcaggatctcaagtccagggacatgctcacgcagtgccatcagtaccgatgtgcggtcgacatcgggtaaagcgccatcaagacgctcttcgtacaagatgctcatgagtaggcttcgctttgttgtgttgtgtggcagctgatttttgcgcgctgcttctgtgaacagttattaagcgggcttttcgttttcgtctatctctttagctaccggtcagaccattttttttccagctctgtgaccttgtcttggttaactcaatgttaaattgatgtaacataatcacttacgtgatgtgcgtgttttgcgagttaagaacagaaaaattggtcctacctgtgcacgaggtccgggaatgaaagatgaacgtcgccctatttgcgaagtggttgcagagagtatcgaacggttaattatcgacggcgtactgaaggtcggtcagccgcttccctcggaacgtcgactgtgtgaaaagctcggcttctcacgctccgcactgcgtgaagggctgaccgtgctgcgcgggcgcgggattattgaaacggcgcagggtcgcgattctcgtgtcgcacggcttaatcgggtgcaggacaccagcccgctgatccatctgttcagtacgcagccgcgaacgctgtacgatctgctcgacgttcgcgcattactggagggcgaatcggcaaggctggcggcaacgctgggaacgcaggctgattttgttgtgataacccgctgttatgaaaaaatgctcgccgccagtgagaacaacaaagagatttcgctgatcgaacatgcgcagttggatcacgctttccatctcgccatttgtcaggcttctcacaatcaggtgctggtgtttacgctgcaatcattgaccgatctgatgtttaattcagtgtttgccagcgtaaataatctctaccatcgaccacagcaaaaaaagcagatcgatcgccagcatgcgcggatctacaacgcggtgttgcagcggctgccgcacgtcgcccagcgcgcagcacgcgatcatgtgcggaccgtgaaaaagaatctccacgatatcgagctggaaggccaccatttgattcgctcggcggtgccgctggagatgaacctgagttagctggtattaaatctgcttttcatacaatcggtaacgcttgtacggctccgccccaatgcgttccagcatgttattcatgcctgtattggtttcgaggatccatgacatctccagcgcatcgatcttccggcgggcaaacggatcgcgtaaggcttcaatcaataacagcgcaatcaccgggccgatgcggctgaactgatactcgtcgcgcacgcccatcagcggtactcgcgcagttcgcacaccgctgactttcaaacgccacagcaattttgcccagccgaagggaaagagcgatccgttcagatcggcaatcgcctcgttgatgttcggcaagccgacaataaacgcgcagggtgcagaatcaatctcagcgatatagatcatatcgtccggcaccagatatttaagttgatcgcccatggtcgcgaattcatgttcggtaaacggcacaaatccccagttgtgctgccagccagagttgaaaatctcacgcaggatctgcatctcttcggcaaaccgctgacgattgatgcagcgaatggtcacctttttgcgcacctgatccatcagtttttttagcgccggagagaaagtgagatcggttcgctgcatccaccacgccagtaaatcaatgcctttgtgataacccagttgttcaatatgcgcggcataccacggtttgccgtgtggcatcatcgcacagggtggtgtgtcaaaaccttcaatcagtaatccgctttcctgattgatattcaggctgaaaggaccgctgatcttacttgcaccttgtgacttcaaccacgcttccgctgcgccaaacaacgcggcaaaaacctgcggatcatcaatggcgtcaatcatgccgaaatgaccggtatctttgccgtaacgctcgcggtgcaaggtatctatttgcgcggtaatacgcccaactatctgccccgctttttttgccacccacgcctgccagatgatatggtccgtccccggatttttcgcagacaaatgctcgttgcgttcaatgaataaagggggtatccagtttggatcgtcgggataaagtgatgacggaaaagcgataaatgccttaaggtcatttttattaaggaaggtgcgaacaagtccctgatatgagatcatgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaaaaactggggataacgccttaaatggcgaagaaacggtctaaataggctgattcaaggcatttacgggagaaaaaatcggctcaaacatgaagaaatgaaatgactgagtcagccgagaagaatttccccgcttattcgcaccttccctaaatcaggtcatacgcttcgagatacttaacgccaaacaccagcgaaatgagcggcttgccgacgatcaacaccgcgagcgccaccagaataccgattccgcccgccagtaaaccggacttcacacctaacaaccacggtctggtggtgcgcggatctaaacgcatcacctctgggtaaaaacttttacccagcaaacccgctggcgttccggcggcgtcgaagaatgtcatggcgattttaaataacccggcggcagcgggtcctaacacgatccccaccaacactgtgctgcacgagttacgcgccgaccagatggagtgggcaatgttggttgaccagacaaaactccacgcgcctttaatgtatcgggcagactcaaacagattcaatttgaaggcgttatggatatttcggcggcgtaattcgcgcgcggcaaaccaccagtacatggtgccgccaaccagattcgacacgtaccaggcaataacaaaacccgcaaaaccaaagtcaaaataccaggctacgacgctccccgctgcgcgcagaaaaggtttcgtcgcctgctgtacagcaattaaatcgaagcgatctaccgcacgcagaatgccggtcggcgtggaggaagccattgaaggaatgagcgtgcaatagagcgctgccagccaaaaactttggtcatccagacctaatgaatgggaaaggaatggcagtaaggcaatgccaccgacaatcgccaccgcgccgctgacgatatccagcgagaaggaaaatgagacgacattgcggaattgctgcggattattgttggttaatgctggtgttccgtactgaaccaccagttgccatgtctgaaacttaataaaatcgctgatcgacttggcgtacgattgcacaatcaccagtacgccaaacatggcgggcgtcatccctttaccggcacacgagagcgccaacagacccagcaaggcgctcacgacattactggagcctaaccaggcgctattgcgaataatggtgcgaaacgcgccatctgcaaaccaatgtttgatgttaaaacccgccaattcagcctgaccttatcgttgatagtaaaaagtatcccgccagccttaagttaaacttcggcggtcagaaacgatggcaaccagagaaaccgccttctgtgcctgttccagcacttcgctgtagggcgctctggaatcaatctcaagaatttttgtgccgttatagccaatcttcgacatgacaccgattttgtcctgcagctcggcatagtcatggtcaggcttgcgggagatggcagtctcaatatcaatgcccaggcgaataattaattccgggcgatattgcgccatttgttggtataaacgccgttcgcgctgcgccagaaacatgctgattttcccggtcgcacgttcgacgccaatccccggtccatcataataaaagcccgaaatttcagcctgcgggaagcgatcgctgaccaccagaacgccactttgcgccagtcgctgaaccttgcgtagattcgccattcttcgcagcgagaagcagtacataatcaccgccgcccatagcgccggagatttggttttcatgctttgggttttcgaggatttggccgccagtcgccgttccagccagacgccaaccaacggcaatcgtttgattttgtcgccgtcttcgccggagagcagccccagatagcgccgctcggtttgccagtgttgttgcagcgatttcaccaggtcggtggtcagtgtggatttaccggtgccatcacacccgaccaccgcaatcagccccggaatgtagttgggctgcggcgcggttgtactattaacagtttgagtttgtagtgcatccattcgttaaatcatcccctatccattttggtgatcaggaaagcgcggcgtgaattgcgcgtagtgacgcttgcagaatttcatcggcggggtgtcgcccatccagttcaaggatctttgcgccattgaatgtcagttgcggcgtaacggcgattttttcctgtaacgctgccagttggtggtcaggtttacgcgcaaacgcggtttgttcatcaatgccaagacgaatcaacaatacgggcaaataagatgccatccattggtacagcttcagctcgcgctgccttaacatttttatccaaccgttaccgcccgtggtttttgccaattgcgggccatcaaagcgaaaccccggcacttcaacctgcgggtagcggtcggtgatgagcagaaagccttgctggcttttacacaacattttgcgaaacttgtacgcccgccagcaggaaagcagatagataaccagtgcagtaatattgccaggcggtgttgagggcttttcgtgcacatgtgccgctttacttcgcagataacgcccaaaaggtgcgccaataacagggagctgtgaaatccattcgccaattcgcccggacgattgcccgagataaatgtgttctgttggcattcttgctgccagttcatttaccaggcttgccgtgagggtcgatttacctgaaccatcacatcctacaatggcaataacacgcactggcgtggaattaattattgacatattacgttgattcacgaaaaacccggcagtaaataatgtattgaatattacgtggtccgtgctcagaatatccgttcaaccttattgtgacaatggttaattgtgacattgacctgaattacgctttcataaaaacatattaaccaaataaatatttttaatggatatttaaattaaaggatatattcatgcagtcaataacacctccattaattgccgttattggtagcgatggttcaggcaagtcaacggtgtgtgaacatcttattaccgttgtcgaaaaatatggtgctgccgaaagagttcatttaggaaaacaggccggaaatgtcggtcgtgcagtgacaaaattaccgttgatgggaaaatccttacataaaacaattgaacgaaatcaggtgaaaacagcaaaaaaattgcctggaccagttccggcgctggtaattacagcgtttgtcgcccgtcgcttactgcgctttcgtcatatgcttgcctgtcgtcgtcgcgggttaattgttctaaccgaccgttatcctcaggaccaaattcctggcgcttacgatggtacggtgttcccacctaacgttgaaggtggtcgttttgtctcatggctggcaagccaggaacgtaaagcgtttcactggatggcgagccataagcctgatctggtcatcaaactcaatgttgaccttgaagttgcctgtgcacgtaaacccgaccataaacgggaatcgctggcgaggaagattgccataacgccacagttaacctttggtggtgcacaactggttgatatcgatgccaatcagccactggaacaggtgttggttgatgcagaaaaagcgattacggattttatgaccgcgcgtggttatcactagtcaaaaatggaaatgcccgatcgccaggaccgggcattttcaggaaggttaaatcaactgcaatgctatccagtacagcccaccagaaagaaaaattgccgccggtaaagtaaatacccacgccatcaggatgctggttaccgttttacgctgtaacccaccgccgtccaccaccatcgtccctgcaactgcagacgagaggacgtgtgttgtggagacgggcatcccaatataactggcaagaccgatagacactgccgccgtcatttgtgccgccatgccttgcgcatacgtcatgccgcgcttaccaatcttctcaccgatggtcatcgctacacgacgccagccaatcatggtgccaatgccgagcgccagtgctaccgccatgatgatccacaccggagcgtactcaatggtgcttaacatatcgctgcgaagttttttcagcaggttctggtcttctttactgacgcctggcagtttcgctagcttcgcggaggtatcagagatgcacagcataatgcggcgcagctggctgcgctgactcacgcttaacggctcgtaactttccatattgcctggcagcatcgttttaacgcgcgcaatagcatcaaaggtatttgccggatgacagtgaaactctgttacttgcgtgccatcagtcgatgctgcaggcaatggaggttccatcgcaatcaacttctgcggcagttcaggatgctgttgcaggtagtgttcgaagttggtaacggcatcgcgggtacgggtaatttcatagccggacgcattcatattgacgacgaagccagcaggggcaatccccaccagtaccagcattaccaggccgatccctttttgtccgtcgttcgcgccgtgcgaaaacgccacgcccgcagcggaaacaatcagcgcaatacgcgtccagaatggcggtttacgtttgccttttttctttttgcgatcttccggaatgcggtgaatacggtcacgctttttcgtcccgctccagtagcgtcgcagcaggaatatcaggcctcccgcaatgaccaggccgacgataggggaaacaatcagcgaggagaaaattttggtcacttcacgcaggtttaacgcatccatcaccgatgagccggttaacagcgcgttggttaaaccgatgccgataatcgcaccaatcaaggtgtgcgaactggaggccggtaaaccgaagaaccacgttcccaggttccagataatcgccgccagcagcatggaaaagaccatcgccaggccgtgggttgaccccatattcagcaacaaatcggttggcaacatatggacaatggcataggcaacgctaagtccgcccaataacacgccaaaaaagttaaaaaatgccgccatcaccacagcaagttgtggttgcatggcacgagtataaataacggctgccaccgcattcgccgtgtcatgaaaaccattgattgcttcgtagaacaacacaaatgccagagcaagcaataacaaaagccctgtgtatatatcaaggccaacaaataaatttagcatatattagattacgccattttgaatttacgaacggacgcattatcagtgactttaacggcatgggcaaagtgaaatatcattttttaacgataaaaagagtgttatttcttgtgtatcagacaataagcattcattcaaaacctttagaaataatcaaaacacaggtattccactggttaatatattcacatatgaaatgaataaatattggaatatataaatattgaatattttgattaatccccgtactgattattcttcataatcagtacggggttgctacaacatgtattactttttcaccacaattaacggttcaatatcactctcttttttgatgaccagtgattcatcaccgcgcaaacacgtcccaccgtagttgccgccaacggtgaaggtacatacctgaatgtatttaccgtccactttcggcaaacaccacagttgctgatagatgtttttctgctcggcaaatttaccgctggttttgtccagcacctcttcatgatggctgacgaggtcgatattgctgccacagcgaccggcgatcggtttcactgcgtaacctgttttcaccagttcatcattaacagtgaaatcggtatccagcaggtaacgatggtgcgggaacagcgaccagaggatcggcagaatcgctttgttgccggggatcaccgtccacagcggctcaaagaccagcacttccgggcgcagcaatacgtcgataagacgcacttcgttttgcggatgaccggtacggattggcaccgcagcaaactcacggtcgctaacttcacgaatctgatcaaacgcggtttcccacgcccaggttttccacacgcagttaaccagtcgcccttccccatcaatcagttgcccggcagcatcccagcccagttcatccaatccacgcaagatacgcgtttcaaagcccgcctggtgcagcgcctgctccataaactgcgcgtgatagttttcctcgatatctttgtcctgcatgatatggacaaacggacgtgcacgactgtgtttccaggcaccagccaattcgttaatcagcccttccgccggattgaagccgttgcctttatagccctgctccgcccaacgttcgaggatcaagcccgcttcggtatgacaggaggcggagtcggcgttgtactcgtaaaccttcaggccacgctcatccatgcagaaatccatacgaccagtgatcatatggtgacggcgacgctgccaggagagacgcaaacgtggccagaggattttcgggatgtcgaacagcgccagcaggttgtcatctttcagcaccttgtcggttgcgtgaagatacatcaggtgcagctcgttggtggctttaattagctcctgctcggcactctcggtaatggtgtagtaatgataaggatcctgattgatcacctgaccgttggcctgcacataggcgttttgcagcggatctttttcatccagccatttaccgtcaaactggcctttgttttccaggcgcgctccgctgattttcagcagctcgcctgcaatttccggctgcggtaagctgtattcagtatcttccgtctggatcatccagcccagaatggtggtgtcatcaaaagtgtctttcagggtatagcagccgttttcgaccaccatctccagctcgcgcgtccactgttgcccttgcggcaacggggaatgaatcacgttctgttccgcaatacggactttgttgccatgcaattgggtaatgatggcgacatggccagtgtctttaaattcaccgcctttatcccagataagaagcgcacccgcgaccggcgcacgcggcgagccgttaggaaatgcctgcaatggcaggatgttgtcattaaccacttctcgcaggaagcgcagcgagaaaatctcccacgccatacccacgtcagtaaagaccacaccgtaattcagaaagagaaaacggcgagcaaattcaacgcattgccacttgtggcccatatattcgtcgtcgatatagctacggaatacggcgtcatcttcgtattcctgcggatcgagagaactgtaatctgaagagtagattgctaccccacctggggcgtagcccaataatgtcccgaacggggcatcctggctggtcgttcctttgctcatcactttacctttaacaatacaacctaagcagttggcgtaattgttgtgctctgattacctgctcagcgacattaaccggacagaggtcagactaatcatacacctcatcgcagcggctggcgcaaagggttaaaaaattcacattctgtacagcaagtgacctgctacactgcttcaacactaccactcagaaggcaactcactatgacagacaatacttatcagcccgcgaaagtctggacgtgggataaatccgctggcggcgcgttcgccaatatcaatcgcccggtttctggtccgacgcatgaaaaaacgctgcccgttggcaaacacccattgcaactttattcgctgggaacgccgaacggtcagaaagtaacgattatgcttgaggagctgctggcgctgggcgttactggtgcagagtacgacgcctggctgattcgtattggcgatggcgatcaattctccagcggctttgtcgaagtgaacccaaactcgaagatcccggcgctgcgcgatcatacgcataatccgccgatccgcgtgtttgaatctggttcgatcctgctttatctggcggagaaatttggctacttcctgccgcaggatttggcaaagcgtactgaaacgatgaactggctgttctggttacagggcgcggcaccgttcctcggcggtggttttggtcacttttaccattacgcaccggtaaagattgagtacgccatcaaccgctttaccatggaagccaaacgtctgctcgacgtgctggataagcaactggcgcagcataagtttgttgcgggcgatgagtacaccattgcggatatggcgatttggccgtggtttggcaacgtggtgttaggtggtgtgtatgatgccgctgagtttcttgatgcgggcagttataagcatgtacaacgctgggcgaaagaagtaggcgaacgtccggcggtgaaacgtgggcgtattgttaaccgcaccaacggaccgctgaatgagcagttgcatgagcgccatgacgccagtgatttcgagacgaatacggaagataagcgtcaggggtaagggttggtgttcgtcgcagcaagccatccaggccggataaggcgttcacgccgcatccggcaatcgtgcacaatgcctgatgcgacgctgccgcgtcttatcaggcctacgaaagctaatcatcacgcgctggtaatgtcgtaatccatttggcgcagtgcgtctaatgtggctttggcttcatcttcgtcgatgatgctcatggcaaatccgacgtgtaccagcacccactggcccagtagatcggcagggttaccttcacaaatcagggcgatattcacatcgcgcttgataccacatacttcaacctgcgcaagctggtgaatatcttcaccgacagccagcacctggcctggaacgccaatacacattattaactccggttattcaacttcaatacttttgacgatcagcgaatcgccggtatcgacacgcaaccgctcgccgtgacagagcggacactgcgcatcgtgctgatgaatctccaccacctggctgcaatcccagcaccaagcctgggcgggtttatagacgatatgtaaatcgcacccttgcgccaccgttccgtggcagacaatttcaaaactaaaacggacggcgctctcctcaacgcaggagagcgcgccaatttccagccacacggcggtgacgcgcttaacatcgtgctgctccgcctgccgttggataatttcaacggcgctctggcaaagagacaactcatgcattttcgccactcctgcgaccaaacagcagggcgcgacgccctgcgtgtggtacatccggattcgtgactggcagcgaaaggatcattcgtgcgcagtcatccgtcaggcgttggccctcttcaatcgacatgctgtgcgaaagcggcgacatcagcgaacaggagagatattgcgaaacaccgtccagttcgccaacggtaaaggtcatagtgccatacggcagttgcagaccaattttttcactcactttgcgcagcggccagagttgatccgggccggggaagataactgcactcagcatccacggggtgatcacacaccccgtccactgaccttcgaacagcgtaaaatcagaaacatacaccggcattgaaggatgcagaaaagagagatcgtgcatcgaacgccgggcaatttcttcaaacgctgcctgtacttgcgccttcggggaggtctggaaacctgctatctcttcagtcatgaatcgcctcccgtgggatggcttccacgccagattcacgcagcgcagccagaacctgctcaagcgcaggttcaatcattgcttcaaccgtcggcgttaagccgatgtgtggctccagcgattccgggatcacgccgaccagggtcagctttttcggaaactcgccggtgaagcgcagggccgacaagacgtcggccaggccaagctgatgcggagagattttgttggtaaacaacgccggaacttcttcatcccgcaggatcatcatcgttcccggcgcgttctttttcgagacaatggcatccgcaataatcaaatgatcgcgatttgccatgtcgccaagcagctccattcccgccgtgccgccatcgaggatctcaacataatccggcagaatgtatcgttgctctaacgcttcgacaatccgcacaccgatggcttcatcggtcagcaaaatattgccgacccctaagactaaaatacgcattacagaaccttcactgaaaccacttcgttgccgtcagcatccactacgtgtaccgcacaggccatgcacgggtcaaaggagtgaatggtacgcaccacttccagcggtttattcggatcggcaaccggtgtacccaccagcgactgctcgtaaggaccgacgtcatcattgaagttacgcggaccagagttccaggttgatggaacaaccgcctggtagttgctgatgataccgtctttaataaccatccagtgagagagcataccgcgcggcgcttcgaggaagccaacacctttgaattcacccgttgccggaatgttcggcttcacaaaggtggtgtgatcgcctttgccgatattggtgatcagtgcactgtattggttttgcaggatatcctgcaattcacagcagtgaacggtacgaccaataatacggcccagcgtggagtgcagctgtgccacttccagcgtgttgccagtcagtttctgataaatcgcaacgatttcattcagtttgttctgggtagattcgcgacctgccgccagtttcaccagcatattagccagtggccccacttctaccgttttgccgtagaaagtcggtgatttcacccaggaatatttcccgtcgtcagaccaaccatcataagccggaatggtggtgccttcccacggtgcctgcggcgcttcgtctttataccaggagtgcttcgcgctttcctgaatgcctttgatcaggtattcatcggaatgagaagtgatcggacgatacgaggacagatccgcattctcaatgtagccgcccgggaacaggaagctgccgtttttactgtcggtcgggaattccggcacgctcaggtagttcaccgcacctttaccgcgtgtcagccattccgggtagaacgcggcaataactgcggtatcaaccttataaacctgctcaacaaagtcgctcagtttgtcgatgaaagacttgatgtacatcaggcgctcaaggttcagcacgcccaaaccgtcgaggttgatcgggttcgcgacaccacctaccgccaggttctgaatgtgcggcgttttaccgcccagcagcgccacgacgcggttagcgtcacgctggcactccaacgcttgcaggtagtgcgctaccgcaatcaggttcacttccggcggcagtttcatcgccggatgaccccagtagccattagcgaaaatacccaactgaccgctggcaaccagatctttgatcttgttctgaactttggtgaactcttccggactgttcaggtgccaggtcgaaacgcctttcagcatttcggaggctttggttgggtcagcttgcagtgcagaagtgatgtccacccagtccagcgccgaaagctgatagaaatgaacaatatggtcatgcgtggtgtgcgcagccagaatgatgttacggatgtattgcgcgttaaccggaacgtcgatattcagcgcactttctgccgcacgaacggaagacagcgcgtgagtggtagtacatacgccacagatacgttgcacaatcatccatgcatcgcgcggatcgcggtttttcacgatctcttccatgccgcgccacatggtaccggaagcccatgctttcgaaacgacgccattttcgatttcgcaatcgatgcgtaaatgcccctcaatacgggttaccggatcaatagtaattctctggctcatgctttgctcgcctcatgacgattatgatcgttttgttttaaaggaggaagtatcggcagtagacgaatgagtacgatgtaagcgcaaatctcaatagccacaaaaccaatagaaatcaacagttcttcccaggtcgggaagtaggcgtaaccgccgcccgggttgaatgccaccagcgaataggtcagacgccaggttgcacaacctaacagtgcgctcagtgctgacaggaacagcatgcgggaatcattacgcagcttcgccacacgcagaacgaccagcgggaagagcatcagcaggacttcaatccagaacatcacggagtagaagtcaccggcaaacgctaacgacagcttgtcgcgatagataagctcgccaaagcgcagcacgatgaaaatcgccagcaacacactgatggtgttggtcagcttaacaaacagactcttttcatccggaccgttgccacgcagacccgcctgcaccagcgaaccttcaaagatgacaatcgagaagcccatgatgaacgccgtcagcagcgagaacagcggcaacatttcatagctctgccacaacggatgcaccttgtagcccgccgagatcatcagcgaccccattgaagactggtgcatggtcggcagcagcgcaccgagcgcgatgatgaagaacatcaccttgtttagtcgctgtagcgacaccttccaccccagacgttcaaacagtgccggagcaaactccagtgccatcacgccgatatagatggtcatacagaccgccgtctcgaacagtaccgagttcacgttgaagtgacccggaatgtagaagtacggcaggttccagtagcgacccacgtcgatagtgatcgacaagccacccagtgagtaaccaaacagactcgccaacagcgccggacgcaccagcggatggtattgcccacggttaaagacgtataccgcccacgccagcgcccagccgccacaggcaaagccggtgccaatcagcaggtcaaacgcgatccacacgccccacgggaagccgccgttcaggtcagagacagagcccagaccgaacaccagacgcttcacaatcaggagcatacagatgacgattaacggtccaaaaatcatgaccggtttactgatgattttgccgcccagcggttgtggatcatgactcatgatcgtctcctccgtcgtgatggtcgtttttggtgttgcgacgaaccagcacggttaagcccgccagcacagccagtggtagcatcatgcctttatacagggtgtgttgaatattttcggaacgcgcaccggtagaaagatcgtccagtttcggcaggtcgagattttcataaggcacacccgtcagtaccagaacctgagtaccgccgccctctttctcgccgtacagatgcggataatatttcggcaccgtatgcaggtaagtgtcgccagatttcagcgtctgacgcggatagtggtattcgctgccaggcttcagcgccagacgttttttcgcctccgccatcagctcttcacgcgtaccgaaaatcaccgcgcccgccgggcacacttctacgcagccaggtagaccgcctttatcgagacgttccacacctttctggttgcacagctcgcacttatgcagcgcaccaaacgggttgttgtagtcgtacttcggcacgttgtacggacaggcgaccatgcagtaacggcagccggtgcacacatctttgtcgtaatggacaatgccggttttcggatcttttttcagtgcagagaccgggcacacagagacacagttcggatcgacgcagtgcatacactgtttcttaatgtacgcgtagccgttctcctcctggtctttgttgacccctgtgccgctggtccacacctgaatgatgttattggtatacggcgacagtttgtcgttgttcgaccaggtctgttccccttgcgggttacgttcagggaaattgatatcctgacacttggtgacgcaagcctggcagcctacgcacaaggtcgagtcgtacaacatccccagcgatcccggaattggcgggcggttttcagcagccgcatgactgacagacggcagcgcgcccgtcagcaatgccccgcaggaggctgctttaataaaattacgtctgttcacggttattctccccgtgagtcagcgttatctttcttttgctgacgacccagttcacgcaccgccatcacgctgacaccggcaaccaacccaaccacaccgccgagcaaaccaatagcgcctgcagagacgttgccgccctctttagcgttaacatccggtttctgtgaacgcggagtttgattttcgacgttggcaagctgatggatgcctttatggaagccgataccttcttcgttacagccatagcaagggtgaccaatcgccaccggccacacaccgccaacatcgcagaattgcagcgttgagcagttgccgtaagtttctggccctttacagccgaggtggtacaggcaccagccttcgcggtggccttcatcaccgaactctttggcaaaacgaccagcatcgaagtgcgggcgacgttcgcagtgttcgtgaatcagacggccataggcgaaggtcggacggtttttgtcatccagtttcggcggtttgccgtaagtgatgatgtgcgcaacggtcgcgaggaagttgtgcgggttcggcgggcagcccggaatattgataacggttttgcctggcagaacttcttgcaggctgactgcgccagttgggttaactccagctgcggcaacaccgccccacgcagagcaggaaccgatagcgataatggctgctgcgccttccgccgctttgcggatgtgatccacaatcggctcaccggcaaccatgcaataaataccgttatcttttaatgggatggaaccatccaccactaacacatactgccctttgtacttctcgagagcgttatgtttgttctcttcgacctgatgaccgaaggcggcggaaagcacttcgtgatactccagagagatagtctccagtacgaggttttctaccgttggatgcgttgcacgaagcagagattccgtacaaccggtgcactcctgcgcgccaatccagataactggcggacgctgcgggttagtaaccgattcggccatctctgcagcggctttgctacttaaccccatggtggcggctaatgctgcacaaagcttcatgaaatcacgacggttaatgccgtgagaatggatgagggtgttatctccagtcatttatagttattccgttgcgaagacctggcatatattttgcctcaatcgcaaaatcaataatgcgatcgatgcgccatttaccacacatttattatggttatcgatatcatgatactgcggcggggcgctaaaacgaagggaagaagcattagtgtaattaattaaagcaagataatacgtatgtttgatcaattttcgaggcgataaccggccataaaaaagcgcaacgtagaacaggaattattctcacgaaagaaatccattaccatctctttatccagtccatagcggcgcgtcagaatacccgcttcccaggcgctaagctggcgatctccggtcttttcgtacatccggtgtgagtagcctaatacaaaaccgcgtttataatcggcacagaattttgtcacattaaccgcactgtcggcatgcgttgcttttaatcccgccattaagcctttaccaaaatggttattcatcgttcacctcattcgctatatattgtcatatatagcgatattttaggcaaagaacgacttttgcgcacgctattttttcatgcttgtttaagacgtaatcccgtaagagataaacctatcaggagagatatttatcgaaccatttcagtgtcctttgccaggcaagatcggcggcagatttgtcataacggggcgtggaatcattatggaatccgtgattaacccccggatagatatacgcctcataaaccttattattggctttcaacgccgcctcgtaagcaggccagccctcgttgattcgggtgtccagttccgcgaagtggagtagtaaaggcgcttcaatcttcgccacatcggcagtgggtgcctgacgaccataaaacggcaccgcgcaggccagttccggatacgcgacagccgccgcgttcgatacgccaccgccatagcaaaatccggtaatacccactttgcctgtcgcttgcggatagcgttgcataaactcaattgcggcaaagaaatcattcatcagtttgttggatcaacctgctgttgcagctcacgacctttatcatcatttcccggataacctccaacggaacttaagccgtcaggtgccagggcgatataccccgccttcgccactcgccgtgccacatcttcgatatacggattcagtccacgattctcatgcaccaccactacggctggcgttttgccgctcatctttgcgggcttcaccagataaccccgcacctcgccgtgaccatttggcgaaggatacgtgatgtactcagcaacaatttccgggtcggtaaactctacctgagtcgccagcgcataatttggcttgagcaaatcaaacaacgctaatgccgtcatcccgcctaccgcacttcgccgcaaggttgaggaactcacgtttcgagattttcccgtgagcgtaatagtcatagtaatccagcaactcttgtgggaaatctttggcggttaaacgcggcatcgttgcactcctcagttggtgtttttttaagcaaagcataagcacgtatttttgcccagtttttcgtcactctgtgagccagactacgggatacgcgctggcgaatcgctaaactagaaacattgtttcgaaattgaacggtggaaaggagaggtcatggtctggttagcgaatcccgaacgttacgggcagatgcaataccgctattgcggaaaaagtggtttacgcctgcccgcgttatcgctcggtttatggcacaatttcggtcacgttaacgcgctggaatcacagcgtgcgatcctgcgtaaagcgtttgatttgggcattacgcactttgatttagccaacaattacgggccgcctccaggaagcgcagaagagaactttggtcgcctgctgcgggaggattttgccgcttatcgcgatgaactgattatctctaccaaggctggctacgatatgtggcccggcccttacggctctggcggttcacgtaaatacctgctcgccagcctcgaccaaagcctgaagcgtatggggcttgagtatgtcgatatcttttactctcatcgcgtcgatgaaaatacgccgatggaagaaaccgcctctgcgctggctcatgcggtacaaagcggtaaggcgctgtatgtcgggatctcctcttactcgccagagcggacgcaaaaaatggtcgagttgctgcgcgagtggaaaattccgctgttaattcatcaaccttcgtacaatttactgaaccgctgggtggataaaagcggcctgctggataccctgcaaaataacggcgtgggctgtattgcctttactcctctggctcagggattgctgaccggaaaatatctcaacggcattccgcaagattcacggatgcatcgtgaagggaataaagttcgtggtctgacaccgaaaatgcttaccgaagccaacctcaacagcctgcgcttattgaatgaaatggcacagcagcgtggacaatcaatggcgcaaatggcgttaagctggttgctgaaagatgatcgcgtgacgtcggtattgattggtgccagccgcgcggagcaactagaggagaacgtgcaggcgctgaataatctgacatttagcaccaaggagctggcgcagattgatcagcatatcgccgatggcgagctgaatctgtggcaggcgtcttccgataaatgacctgttaataacgggcgcgcgaaccgcgcccgaatcagatcagtgattatgacgagtcagtcggtcaagatagcccatcacaaatgcagaaagcacaaacgtcagatggataatgacgtaccacatcagtttgttatccgggacatttttcgcatccataaagacgcgcagtaagtgaatggaagaaattgccacaatcgacgctgctactttgtttttcagcgacgttgcgtccattttccccagccagttcagcttctctttgttctcggagatatccagctgtgagacgaaattctcataaccggaaaacatcaccatcaccagcaaaccgccaaccagcgtcatatccaccagcgacagcaacacgaggatcaaatctgattccgccatcgagaagatattcggcagtacgtgaataatctcctggaagaacttcagcgccagggcaactaacgccagcgaaaggccaaagtacacgggggcaagcagccagcgagaagcatacattgcattttcaagaaaacgttccatacattcctgtcgtgtagttaaaacgggcaacagtatatcgcaattgagtaaacagcacgcaacagcaaatcaacatatacgttaaacctttgtcgcataattctgaggtttagggatcttcctggttcccttatcaacgcatcgagaacgtctacccttaaaggacgttgaacctgaagggagaaaaacgatgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaataggtcgcgctgccgccatcgcttacgcgcgtgaaggggctgacgtggcgatcagttatcttcccgtggaagaagaagacgctcaggatgtgaaaaagatcattgaagaatgcggacgcaaagccgttctgctgccaggcgatttaagcgatgagaaatttgcccgttcgctggttcacgaagcgcacaaggcgttaggcgggctggatattatggcgctggtcgccgggaaacaggttgccattccggatattgcagacctcaccagcgaacagtttcaaaagacctttgccattaacgttttcgcgctgttctggctaacccaggaagcgatccccctgctaccgaaaggtgcaagtatcatcaccacttcgtcaatccaggcataccagccaagtccgcatttactggactatgcggctacgaaggcggcgattctgaactacagccgtggcttggcaaaacaggtcgcggagaaaggtattcgggtgaatattgtcgcgccaggcccgatctggacagcactgcaaatttccggcggacaaacgcaggataagatcccgcagtttggtcagcaaacgccgatgaaacgtgcggggcaaccggcggaactggcccctgtatatgtttatctggcaagtcaggagtcgagctacgtcaccgcagaagtgcacggcgtgtgcggcggcgagcatttaggttaaaaaaatgcccggttgtgaaaagcaaccgggcatcattgtgaattcactcttacctgatgtggcgaaaacgccttatccgcctacaaacgcatgaagattcaacatgttgcaatagattttgtaggcctgataagcgtagcgcatcaggcattgagcacctaatgccggatgcgtcgtgaacgccttatccggcctacaaacgcacgaagattcaacatgttgcaatagattttgtaggcctgatgagcgtagcgcatcaggcaattctactttacttcgctttggcggtttcttcgccgaccagacctatcttcaggtaacccgcctgatgcagcgtatccattaccttcatcaacgtctcgtaatcgacggttttgtccgctcggaagaagatggtggtgtctttcttgccttcggttaacgcattcaacgccgtaatcattgtttcatcggtgaccggatcgttaccgataaacatcgagttgtctgccttcaccgacagataaaccggtttttccgggcgcggctgcggcgtgctggtagaagcaggcaagttcaccttcacatctaccgtcgctaacggtgccgccaccataaagataatcagcagaaccaacatcacgtcgataaacggcgtcacgttgatatcatgcatttcgccgttatcgtcgaggttttcgttaagatgcattgccatcggatattatcctgcgcgtaatttttgtgcgacacgaaccggatgcgcagcggcgctggcttccagatccaggtcacggctttgcagcaacaatacctgcgctgcaacatcacccagcatcgctttaaagccgccaatctggcgtgcaaatacgttatagataacgaccgcaggaatcgctgccacgaggccgattgccgttgctaacagagcttctgcgatacccggcgcaacgactgccaggttagtggtctgcgtttgcgcgataccaataaagctgttcatgatgccccagaccgtaccaaacagaccaacgaacggagaaatcgcgccgatggttgccagatagccgttaccgcggcccatttgacgacccactgcggcgacccgacgctccagacggaagctggtacgttctttaataccttcgttatcgtcgctgccttctgacagttccagctcattctgcgcttcattgagcaaatgcaggcttaagcttttgctaccaaaatcagcggcgatatcgttggcctggtttaaggaacgcgcttcagccagcagttgctgctcgcgcttaaggcgacgcttctgattgaagaactctacgctcttactgaagaagattgcccaggtgactacggaggccaaaataagcccaatcatcacgcacttaacgacaatatcggcgtgctgatacataccccagacggaaaggtccgtctgcattaaattattacccactgtgtatctccaggacgcaagtcacaaaatctgcgcataataatatcaaaacgacgtcgaattgatagtcgttctcattactatttgcatactgccgtacctttgctttcttttccttgcgtttacgcagtaaaaaagtcaccagcacgccatttgcgaaaattttctgctttatgccaattcttcaggatgcgcccgcgaatattcatgctagtttagacatccagacgtataaaaacaggaatcccgacatggcggacaaaaagcttgatactcaactggtgaatgcaggacgcagcaaaaaatacactctcggcgcggtaaatagcgtgattcagcgcgcttcttcgctggtctttgacagtgtagaagccaaaaaacacgcgacacgtaatcgcgccaatggagagttgttctatggacggcgcggaacgttaacccatttctccttacaacaagcgatgtgtgaactggaaggtggcgcaggctgcgtgctatttccctgcggggcggcagcggttgctaattccattcttgcttttatcgaacagggcgatcatgtgttgatgaccaacaccgcctatgaaccgagtcaggatttctgtagcaaaatcctcagcaaactgggcgtaacgacatcatggtttgatccgctgattggtgccgatatcgttaagcatctgcagccaaacactaaaatcgtgtttctggaatcgccaggctccatcaccatggaagtccacgacgttccggcgattgttgccgccgtacgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaatgcctatctgatgggccagatggtcgatgccgataccgcctatataaccagccgtggcctgcgcacattaggtgtgcgtttgcgtcaacatcatgaaagcagtctgaaagtggctgaatggctggcagaacatccgcaagttgcgcgagttaaccaccctgctctgcctggcagtaaaggtcacgaattctggaaacgagactttacaggcagcagcgggctattttcctttgtgcttaagaaaaaactcaataatgaagagctggcgaactatctggataacttcagtttattcagcatggcctactcgtggggcgggtatgaatcgttgatcctggcaaatcaaccagaacatatcgccgccattcgcccacaaggcgagatcgattttagcgggaccttgattcgcctgcatattggtctggaagatgtcgacgatctgattgccgatctggacgccggttttgcgcgaattgtataacattgccacttttggacaattttgcagacattttattgtgaaaagtcttaaattgttgcgtccgggatcaaggcgtcccggacgattcaggagtacaataggcagataaaggcttaaacgctgttccacaggaaagtccatggctgttattcaagatatcatcgctgcgctctggcaacacgactttgccgcgctggcggatcctcatattgttagcgttgtttactttgtcatgtttgccacgctgtttttagaaaacggcctgctgcccgcctcatttttgccaggcgacagcttgttgatactggcaggcgcattgattgcccagggggttatggattttctgcctacgattgcgattctgaccgccgcagcaagtctgggctgctggctaagttatattcaggggcgctggttagggaataccaaaacggtgaaaggctggctggcacagcttcctgctaaatatcaccagcgcgccacctgcatgtttgaccgccacggtctgctggcgctgctggctggacgttttcttgcatttgtccgtacgctgctgccaaccatggcgggaatttccggtctgccaaaccgccgcttccagtttttcaactggttaagtggattgctgtgggtcagcgtggtaaccagttttggctatgccttaagtatgattccgttcgttaaacgccatgaagatcaggtaatgacgttcctgatgatcctgccaattgccttgttaaccgctggcttgttaggcacgctgtttgtggtgattaaaaaaaaatactgtaacgcctgacgattttccccgttcccggttgctgtaccgggaacgtatttaattcccctgcatcgcccgcattcttgccgcatcttcccccggcgtcacaccgaagtaacgtttaaactcacggctaaattgcgatgcgctttcatagccgacgcgcatcgctgctgcgctggccttcatgccgtcatggatgatcatcatccgcgccttatgcagacggtaattcttcaaatactgcaacggcgaggtactggtgacagacttaaaattatggtggaacgccgatacgctcatgttggcttctgccgccagttgctcgacgctcaggttttcggtgtatttattctcaatccgtttcagcacgcggctaatcagactgaagtgagtctggcgactgaccagcgccagtaacgcgccgccgcaaggtccggtcagcacgtagtacagaatttcgcggatgatctgtttgccgagaatacgcgcatccagtggtcgctccatcacgtcgagtaaccgctccgccgcgcataaaatctcttctgataacgtggcggagttaatcccgctggctgccatcgacggctggaaatgctcatcttcgccaatgtccatcaacagttcctgtaactgcaaaatatcgacattgagacgcaaccctgccagcggcacctctgacgtggcataggtttcgcactcaaacggcaacggcaccgtcagcagcaggtattcattggcatcataacgaaacacgcgttcattgatataaccgattttatgcccggaaaagagaattatgatgccaggctcgtacatcaccggtgtacgtgcgaaaggcgtctcgccatacaacaaacgcacatcgggcaacagtcctgacaaactattttctttatttttcagtttattaactttatccgccagcaagcggcaaatctcttcacgtttcatatcgcgtaatttcttaggaataatgcggcaatttgattgtgcgcaattttgtagcatttctccagcactctggagaaataggcaagacattggcagaaatgagcattgagagccagggcgctggcgatcacaatgaaaaacatcaggcagatcgttctctgccctcatattggcccagcaaagggagcaagtaatgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgttggatgtcagccgccgtatatacgaagccgcccgctaagctttttacgcctcaaactttcgttttcgggcatttcgtccagacttaagttcacaacacctcaccggagcctgctccggtgagttcatataaaggaggaacgtatggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcggcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctacttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcatccgctgatgcaacaacgccagctacacgcctggaacgcgacacacaaaatccagaccgaatcctggagcccattagcgcaaggagggaaaggcgttttcgatcagaaagtcattcgcgatctggcagataaatacggcaaaaccccggcgcagattgttatccgctggcatctggatagcggcctggtggtgatcccgaaatcggtcacaccttcacgtattgccgaaaactttgatgtctgggatttccgtctcgacaaagacgaactcggcgaaattgcaaaactcgatcagggcaagcgtctcggtcccgatcctgaccagttcggcggctaacatgcaaattctcccggtggcggtaatgttccgctaccggacttttcagaaatcatttattcccctcgcgtcccgcccgttgttactcttccttgttcaggaatgccaaatataaggacatcatcatgcagagccggaagctcttaaaagaacaactcatctatatccgggataaacgcaacggagaggtgaaaaacagatgaaaataatacttctgtttttagcagccctggcaagttttaccgtacacgcacagcccccctcacagaccgtagaacaaacagtccggcatatttatcagaactataaatcagatgccactgccccttattttggtgaaaccggagagcgggcgataacttctgcgcgtattcaacaggcgcttaccctgaacgacaatcttacgctgccgggcaatattggctggctggattatgatccggtttgtgattgtcaggattttggcgatctggtgctagaaagcgttgcgataacccaaactgacgccgatcatgccgatgccgttgtgcgctttcgtatctttaaagatgataaagaaaagaccacgcagacactgaaaatggtggcggaaaatggtcgttgggtcattgacgatattgtcagcaatcatggcagcgtcttacaagcagttaatagcgagaatgaaaaaacgctggccgctttagcttcgttgcaaaaagaacagccggaagcctttgttgccgaactctttgaacatattgctgattatagctggccgtggacgtgggtggtttccgactcttaccgccaggcggttaatgccttctataaaaccaccttcaagacggccaataatcccgatgaagatatgcaaatagaacggcaatttatttacgacaatccgatctgttttggcgaagagtcgctattttcacgcgttgatgaaattcgagtcctggagaaaaccgccgattccgcccgcattcatgttcgttttacgctgaccaatggcaacaacgaagagcaagaactggttttacagcggcgcgaaggcaagtgggaaatcgctgattttatccgcccgaacagcggcagcctacttaagcagattgaggcaaaaactgccgccagattaaagcaatgagctgaattaaataacaattagccggaacaataaataaaagggaacactatatgaaaacgattttcaccgtgggagctgttgttctggcaacctgcttgctcagtggctgcgtcaatgagcaaaaggtcaatcagctggcgagcaatgtgcaaacattaaatgccaaaatcgcccggcttgagcaggatatgaaagcactacgcccacaaatctatgctgccaaatccgaagctaacagagccaatacgcgtcttgatgctcaggactattttgattgcctgcgctgcttgcgtatgtacgcagaatgataaaaaaatccccggtagcgtgtcagttgccggggatattttttaacgtccaaccgccgctttaggccgtttcttcgcaccagcattcaccggacgagattgcgtagacgacgctttttttgccgtagcaggcgtctgacgctgggtcgccatcggcgtatgtttcgtcaacgccggacgggtattgcggttctggcgacgagcttcacgcatctcttcaatggttggcgcaggcactaagcaatcgcgacggctgccaatcagatgctttttgcccatcgcttccagcgcctggcggattaacggccagtttgccggatcgtggtaacgcaacaacgctttatgcaaacgacgctgtttgtcgcccttcggtacgaagacgtcttcgctcttataaccaatcttcgccagcgggtttttcccggtgtaatacatggtggttgagttcgccagcggcgacggatagaagttctgcacctggtcgaggcggaagcggtgctttttcagccacagcgccagattcaccatatcttcatcacgcgtaccggggtgcgcggagatgaaataggggatcagatactgctctttacctgcctgttttgagtaagtatcgaacagctctttaaagcggtcatagctgcccatgcccggcttcatcatcttcgataacggcccttcttcggtatgttccggggcaatcttcagataaccgccgacgtgatgggtcgccagttctttgatatagcgcggatcttctacggctatgtcataacgcacaccagaggcaatcaggatctttttaatgcctttcagatcacgcgcacggcgatagaggttgatcgttggttcgtggttcgtgtccatgtgcggacaaatatccggataaacgcacgacaaacggcgacaagtttgttcagcgcgtggcgatttgcagcgcaacatatacatgttggcagttggcccaccaagatcggaaatcacgcccgtaaaacctggaacggtgtcgcggatcgcttcgatctcattaatgatcgaatcttcggaacggctctgaataatgcgcccttcgtgctcggtgatagaacagaaagagcagccgccaaagcagccacgcataatgttgaccgaaaaacggatcatttcgtaagccggaatacgggcattgccataggccggatgtggcacgcgcttgtatggcagcgcaaaaacgctgtccatctcttcggtagaaagcggaatagcaggcgggttgatccacacatagcggtcgccgtgtttttgcatcaatgcgcgggcacagcctgggttggtttcgtggtgcagaatacgcgaagcatgggcgtacagcactttatcgcccttcactttctcgaaagaaggcagcaacacgtaggttttttcccacggtttcgggcgcggtggctgcacggttacggctttggcttcctgctttttcggtgccaccggtttgttatccgcgcacggcaaatcttcaccatacggatgcgggattgggtcgatttttccaggggtatcaagacgggtggaatccacgccgctccagccaggcagcgcctctttcacgataatcgcggtattacgcacatcgcggatttcactaattggctcgcccatcgccagacgatgcgccacttccaccagcggacgctcaccgttaccaaacatcagcatgtcggctttcgaatccaccagcacggaacggcgcacggtatcggaccagtaatcataatgcgcggtacggcgcagactagcctcaataccgccgaggatcaccggtacatctttccacgcctctttacaacgctgggtataaaccagtgtggcgcgatccgggcgcttacccgcgacgttatccggcgtgtaggcatcgtcatgacgtaaacggcgatcggcggtataacggttgatcatcgaatccatgttgccagcagtaacaccgaaaaacagattcggtttacccagacgcataaagtcgtctttgctgctccagtccggctgggcgatgatcccgacgcgaaagccctgcgcttccagcatacgaccgcaaatcgccatcccgaagcttgggtgatcgacatacgcgtcgccagtaaccaaaatgatgtcgcagctatcccagccaagttgatccatctcttcacgagacatcggcaaaaacggtgccggtccaaaacaggcggcccagtactgcggccaggagaacaggtcgcgatccggttggatcagggagatagagctcattttgcttccagaaatgataaaaaaataatcaaaggccggggattataagccggaacgaaagagaaatcgaaaggtattccatactcgccctcctcgggcgagtatgaagattacggtaccggattgaccaacagttgcccaatcgagccacggtccgccatttccagcgtctgactgttgaagtagaacgggaagtgcgcccaggaaggctgaccgaaataaacaagcagctccacttgtccgtcaacccaaacggtatctttccagcctctgtcttccgggaacggcatcgcgccattcacgttacggatctggaacattacgccttcaatatggaacgcttgcggctcgtccgcgcgtaccgtccagcgttcccacgttccttgctgcgcggtgacatcaatacggttgacgtcccacagctgtccattaatacccgggtcatcacccagactgatatcgcgactgcgaattggcgaaccagccatgatttcagttggcagcaagcgcatcggaagactgtctgtgaccagcggcagaaggccggttgggcgcagcgttagcaccagggtagaaaccagaatactggatggctcaaagaagccacgaatacgatcaacaatgctcgccgcttcgccacaggtgatcgacacttcatcgccgttgctcatatccaccagaatctcgcggcgctcgcccggtgccagcgaaagttgcttcaccgatacaggagcaggcaggaatccctgatcgccagaaatcacatgtaacgggcgaccatcgttcatctgtagttgatagcgacgagagttcgacgcgttcagcagtcgcaagcgcacccagccacgcgagacttcaacgtacgggctttgtacaccgttaaccagcagcgtatcaccaacaaagccgccgcttcccggttcgttgtattctggcgtaccaaagttatccagccgtttatcctggataatgaccggaaaatcatccacaccataatggttggggataggcagcgacttgctgacttcatcttccaccagccacattccggcaaggccgttatagacctgctgagccgtgcggttgggagtattggcgtgataccacagagtagctgcgttctggcgaatgggcagtacgggtgcccagtcagcgtttggcgacatcatccgtgccggaccgcccatcagcgggcctggtacctgtagcccggccaccgtcattgagacattttctgtcaggcggttgctgtaaataagcttaacatcgtcgcccttccagacgcggatagtcggccccaggtaacgaccattgattccccagaccgacgcgcgtgtccctggcgtaaatgaccagtgcgcacgttgtacagtcataaacagcggttgcccacggcgagattcaagtagcggcggaacgggtagcggttgctgttgcccggctgcgctggccttcaggggaacagcgcctgcacaaagtgcaatccccgatgcctgaatgaactgacgccgactgagtgacatatttgctccatgtaaaactggctaaagtaataccgtgcaggaaagtgttccccgcaaaaatacagattgccgacttaaacttttccggcggcttcgcgttctgcgacttctttatcgagctcggcgattttttgttccattatcgaacgacaatgggcagccagctcacgaacctgatctttgccatactgactgacgtcaattggcggcagcatttcgacaatcaccagaccgttgtgcagtcgattaagattaatcttattcgaagttgtagagacgcacacgggaataatcgggacgcccgccgcaattgccgcgtgaaatgctccagtcttgaacggtagcaggccgcgaccacggctgcgggttccttccgggaacatccagatggaaatacggcgttttttgaagtgattcactacttccgcaatggtgccgtgagctttagtgcgattgtttctgtcgatcaataagttgccggttaaccagtacaactgcccgaagaaggggatccacagcaagctctttttacctaccgtcaccgtcggcggttgcacgatgttcgatgctgtcaccatgtcatagttgttctggtggttagcgatatagatagcattgccgtagctttcagcgtctgtaggtttacggcactcaactttcaggccaaacagcggcgcaagacggccaaacatatgcccaaaggtggccacatgtttcgggttacgcgggctgaaaaggcagtaaatggagccgaatacacagactaagatgctgtaaatcacggtaataataagacgaaagatatatagcataacaccctctgaaggtctgagagactggcattgtacgtcacctgaaatcaggttagggcattgttaaaagccgctctctggaaaagcgtattgttaatcgcaacgcatgaataaacaacggtttcaagggaatttttatcgtttccgggggttgaatacgctgccggatgacgacttaacgtttcatccggcgttccttgcaagcgggaggaaacagcgccctccccggcatattactcttcgctatcaccgctgctggcacggcgaggagagtcgatctcaacacgatcgatacgctgcaaaccgcgcatcaacgtaccgcggcgtccacgttcgccagtgactttctgtaactcttccgggcgcagtttaattttgcgtttcccaacatgaatggtcagcgtgctttgcggcggcagaacgtacaattgcgccagaccatcttctccacgcgcggcttctgccgatggaatgttgataatcttgttgcctttgcccttcgacagctgcggcagatcacttaccgggaacatcaacatacggcctgcctgagtgattgccagcagcatatcggaagcatcttcaatcaccaccggcggcataacatgggcattttccggtaaggtgatcaaagccttacctgcacggttacgcgccaccagatcgttaaaggtgcagacgaaaccgtaacccgcatcggaagccatcagcagtttctgatcgtcgctttccatcagcatatggtcaacggtcgccccaggcggcaacgttaatttgccggtgagcggctcgccctgaccacgcgccgacggcagcgtaatcgggtcaatggcatagctacgaccggtggaatcaacaaacactaccggttggttgctcttacctttcaccgccgctttgaagctatcacccgctttataattcaggcccggcgcgtcgatatcatggcctttagcgctgcgtacccagcccatctgcgacagcacaatggtgacaggttcagacggcagcatgtcgtgctcgctcatcgctttcgcttcttcgcgttcctgcaacggcgaacgacgatcgtcaccgtaggcttgcgcgtctgcctgcagttctttcttcagcaggttattcattttacgctcggaagccaaaatgccctgcaactggtcgcgctctttttccagttcactctgctcaccgcgaatcttcatctcttccagtttggcaagatgacgcagtttcagttcgaggatcgcttccgcctgggtttccgtaaggccaaaccgcgacatcagcgccggtttcggttcatcttcattacgaatgatctcaatcacttcgtcgatattgagaaacgccaccagcaaaccttcgaggatatgcaggcgcttgaggactttctccagacgatagttcagtcggcggcgcacggtatcgcggcggaacaccagccattcggagaggatttccagcaggtttttcaccgccggacgaccatccagaccgatcatattaaggttaatacgatagctcttttccagatcggtggtagcgaagaggtggttcatcacctgatccatatccacgcggttggaacgcggcacaatcaccaggcgggtcgggttctcgtggtcagattcatcgcgcagatcgtcaaccatcggcagctttttgttgcgcatttgcgcagcaatttgctccagtacgcgcgcacctgaaacctgatgcggcaatgcgctgataaccaccgcgccatcttctttcttccacaccgcgcgcatacgcactgaaccacgtccgttctcgtagattttacggatctcggcgcgcgaagtgataatttccgcttcagtcggataatccggcccctgcacgatatccagcagctgatcgagcgtggttttcggctggtcgattaatgcgattgccgcctgagccacttcacgcaggttatgcggtggaatatcggtcgccatgccgacggcaataccggtggtgccgttaagcaaaatgtttggcagacgggcaggtagcattttcggctcctgcaaagtgccgtcgaagtttggcacccagtcagccgtcccctgccccagctcgctcaatagcagctcggaatatttcgacaaccgggattcggtgtaacgcattgccgcgaacgatttcggatcgtccggcgcgccccagttcccctgaccatcaaccagcggataacggtaagagaacggttgcgccatcaggaccatcgcttcataacaggcgctatcgccgtgcggatggtatttacccagtacgtcaccgacggtacgggccgattttttaaatttggcgctggcattcaggcccagttcagacatcgcatacacaatgcggcgctgaacaggtttcagaccatcaccaataaacggcaacgcacggtccatgatcacgtacatggagtagtttaagtaggcgttttccgtaaattcatgtagcgcaaggcgctctgccatatcgctcattaattctgattcctcaacttattcgccagccttcaaaggggcaatattgccggagatactacattatctgccgcgtcgagtcacaggagatcaacgtgaatagcgccgccggacgtgctccgacggcgataaaggcatcaatgtgccttgatatacaactctttgctgtagacataatcctggggattatgcagcggaaaaccgccaacgtagggtttaagcagtttgattaacggctgatagtagataggaatcagcggtgcctgttggttgatgatcacttctgcctgctgatacaacgcattacgctttgtcgcatcagtgatctgcgtggcctggtttagtaaggcgtcatactgcgcatttttccagtgaccgacgttttcttcactatcgcttttgagcgtgttcaggaagctggaagcatcattgtacgtcgcatcccacgactgccgagacagcatgaaatcaccggctcgtcgggcatcaagataggttttccactccattgtgcgcagcgtcacctgtgcacccagccattttttccattcggaagacaacgctatcgcggtcttttcatgcagatcgtacttgttgtagaacagctcaaagcgtagcggatgagaggcgtcgtatcccgcctgtttcagcaaggcttttgccatcgcgacgcgctcactcattggcttttgcagttcatcgaacgtcgtcgcgctaaagccttttacctctggcggcgtcagcgtggttgcgggcgttctcaaccccagtaccttttgcgcaataagctgtcgatcaaccgtaagatatagcgcccgacgcactcgcacatcgttaaatggcggtttctcaaggttgaagttgtaatattcgctgttcagacgcggaataattcgtagctcgccaggcagtgatttttcaatggcgggaatttgctgcgccggaacccaggtgagatcgacctctcccgcgcgatagcggttatagccggtgaccgaattatctagcgccagatactcaacctgttgcaatactgtatgttgcgcatcgcggtactttggatttttgcgtgcagtaatcttttcgttaactacccactgatcaagcacaaaggcaccgttgtaaaccatgttctctggcttactccagctatcgccatgtttagcgatgacatgatgaggaaccgggaacagcgtcggccaggcgagcatcgtcgtgaaccaaggaaccggctgctcaagcgtaacttcaagagtacgatcatccgtcgctttgacacccagcgatgtaacatctgctttacccgcaacaatagctgcggcattgttaatgtgcgcctgtgccagatagccagcaaaagggcttgccgttttcgggtcaaccgcgcgctgccagccgaggacaaaatcctctgccgtcagaggctgaccgtcggaccactgcaaaccgctacgcagatggaaaatatagcgcttgccgccgtccagtatctcccagcgttcagcctgagcgggctgcacctggccttcaccgtccatccataccagaccttcaaacagatccagcacaatctgcgcggcagtattctcctccaccttttgcgggtcgagcgtacctgggtcgctatgattgttgtaacgaaagacttgttgcggggcgagcggtgtgttggcgggaacgtcagcagcgtagagaggagccgcacttaccaggctgaccagccataataaatttcgcgtatacatggtattccttaccggagaaattataagcccaacaacaatacgcctgtggcattgttcgctcaaacttatcgcgagtgatttggctcacactccggtaaagaaaaaagcgagttgcccccgcttttccattaattaacggatttcattcaatagttctggatgcttatccagaacacgtaaaagtttgattgtggaaggatgaggttgggcattgcctttttcgtaacgcgaaaacgcatttacacctcccccaaaaatttcgcttgcctctttttgggtaagagagagcttttttcgaaccttcactataaattcaggtgccactgtttcggcattcaccgaagcccgaaatgcctttacttgcgccatgaaagcatctgactcttctttattcatgatgctctcttcgcaatggacacaatataaaccgtggatacctttcaatactgtttttcgtccacggaaggtgtatggaatatctttaatgccagaaaccatttctccctggtggcaaaccggacatttcatattacttctccttaaacgagacgatcagtacgtcatgaattaccgtaattttaagataaacctggcctgtaacaagcctgggtctgtaaacatcctgccagatagtatgatcagagtaggtggtcatgcttttataaaagtcgctctctgataatccaatgataacattacacataccatcaaaatccaaacctaactcatctgcatttaacagggcactacgtgttgtacgaacttgcccggcattgacaagttttttaacctgactcaaacgtgtatgtggtgtgcgtttttccataacccccgcctccctgttactttagttataacctaaaaggttaattacagcaatgaaaaagcacctaaaaggttagttagatgtacggagatagtgaccacacaaaacgtattctttaaggaaagtgattgaccatataagaaagtggcgcattagtagcgccagtttgaagcaggaatttataagggaagctggagtcaggcatcacgccaacggcacataaacatccgtttccagtcgctgctctgtcaccccttcggcaagattggtgtagtgaaacagaatcggtgctttacgcattttctcgccgcttgcaggcagccagtggcgaatgatgccccataccgtgtgtgaaatatcgtccagctcgccaacgtggcgggccacggcataacgtccaccggtaagttcaccattgctcacaccataacgattatcgggaatcggttcgctaacgctgccgcagatatcaaagcgaaacgcttccggtgcggtggtggcagggtcgtcccaggcgacgccaaaagtctggctttggttaacaggagaaagccccgtctctttacgccacatgataaatttcgccacgctgtagttgagcaattcagggctacagcggtgcggcaacatcgccacaggtattgatgggaaatcgataatgtttacatccagtgtcaggtttgtcattttgcctccctgcgaaattattcccgggaacgcgtcccgggagcggtaacaattacggatttactttgcggatctgtttgacgtcaatttcaacagaattccagtctttatcgacttcaccctgaatctcaaccgtatctttcggcgtcaccgtcacgccgttccagcgtttgtggtcgatatcaacattgatagtaccgctggcatctttgaacacgtagagatcgtcagagatgcgttcaacgatattgccgcgcagggttacccaggtgtcgtcacgcagggattttgcgctttctacagtcgttacgctgccgttcggcccctggaatcctccggcctgactttgcgttgccgatgggccagaaaaaccgccctgctctgctgccatcaccggtgcgctgcacagggccattactgcgattactgctgcgaattttttcatgtttattactccctttaatgtctgtttccgagcatttaacaagatagtccttaacaacttcttaagggaaaaaaataaaatttagtgctgtacagagcgcgttacaacacggtttactggcagcaaatacggttatcgcagggatgaaaaaatgcgaattttactgatagaagatgacatgctgattggcgacggcatcaaaacgggccttagtaaaatgggttttagcgtcgactggtttacacaaggtcgtcagggaaaagaggcgctttatagcgcaccttatgatgcggtgatcctggatttaaccttaccaggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggtaacgtcatgctcgaccccggcaaacgtatcgccacgctggctggcgaacccttaacactgaaaccaaaagaatttgccctgctggaattactgatgcgtaacgctggtcgggtactgtcgcgcaaactgattgaagagaaactgtatacctgggacgaagaggtcaccagtaatgccgttgaagtgcatgtgcatcatctgcgacgcaaactcggtagtgattttattcgtaccgtgcatggtattggttacacattaggtgagaaatgaaatttacccaacgtcttagtctgcgcgtcaggctgacgctaatctttttaattctggcctcggtgacctggctgctttccagctttgtcgcctggaaacaaacaacggataacgtcgatgaattgttcgacacccaactgatgctgtttgccaagcggttaagtacgctcgatctcaacgaaatcaacgcggcggatcgcatggcacagacgccaaatagattaaaacacggtcatgttgatgacgatgcgctgacctttgccatctttacccacgacggcagaatggtccttaatgatggcgataacggagaagatattccctatagctatcaacgggaaggttttgctgacgggcaactggtcggtgaagacgatccttggcgttttgtctggatgacctcacctgatggcaaatatcgcatcgttgttggccaggaatgggaataccgtgaagacatggcgctggcgattgttgccgggcaattgatcccgtggctggtcgcactgccgattatgttaatcatcatgatggtactactgggtcgtgaactcgcgccgctgaacaaactggcgctggcactacgtatgcgtgaccctgactcggaaaaaccactaaacgcgactggcgtacccagcgaagtgcggccactggttgagtcgctaaatcaactgttcgcccgcacacatgcgatgatggttcgtgaacgacgctttacctccgacgcagctcacgaacttcgtagcccgttaacggcgctgaaagtgcaaaccgaagttgcgcagctctctgacgatgatccgcaggcgcggaaaaaagcactgctccaattacattccgggatcgatcgcgctactcgtctggttgatcaactgctcacgctatcgcggctggactcactggataaccttcaggacgtcgcggagatcccgcttgaagatctcctgcaatcgtcggtgatggatatttaccacacggcgcagcaggcgaaaattgacgtgcgactgacactcaatgcccacagcatcaaacgcaccgggcaaccgctattgctaagtttgttggtgcgaaatttgctggataacgccgtgcgctacagtccacagggcagcgtggtagacgtcacgctgaatgctgataatttcatcgtgagggataacggccccggtgtgacaccagaggcactggcgcgaattggcgaacgcttctatcgcccacccggacaaaccgctaccggcagcgggcttgggctatcgattgtccagcgaatcgccaaattgcatggcatgaatgttgaatttgggaatgcggaacaaggtggatttgaggcgaaggtaagctggtaacttctctgtctatgagagccgttaaaacgactctcatagattttactaatagcaaaatataaaccgtccccaaaaaagccaccaaccacaaaccagacaaataccgagcgagaatacatatacccaaaactcgaacatttcccgcataaagagttttcttaagataagaataataagtggcgtaagaagaaaaaatgctgcaatcattgcttgcaatatacgatcttcgcctgaaacggaaggtatactgcaaatatttcctcccgactcaagcatccagtcatacttattgaaagcaaaaaaagaatctattaaccaataagtaagcattatatatagcaatgcttcaaatattgttttaattttctgctttaacatatatcagtacgctcataaaaatccatttataattatcaacatgacacgttgatactttcatcttttacttattcaaagccatattttcaatccccaaaaaaaccgaaccaaacgtgtaaattattccggtgcgagtaagaattatgaggaatggctatcagtattgtcattttcagaaaatatttatcctgcatcggtgagtcagagtaagatcagacttttgctaaattcgcaaaagactttgcacattttgctaatttcaccgtaccgctctgtgacgtactatagtcggcaaacgtctcaccttgaggttaaaaaatgagcaacatcctgattatcaacggcgcgaaaaaattcgcccactccaatggtcaactgaacgacaccctgaccgaagtcgcggatggcacactgcgcgaccttgggcatgatgtccgcatcgttcgcgccgacagcgactacgatgtcaaagcggaagtacaaaactttctctgggctgatgtggtgatctggcagatgccaggctggtggatgggcgcgccgtggacagtgaaaaaatacattgatgatgtattcaccgaaggtcacgggacgctgtatgccagcgatggtcgtacccgcaaagatccgtcgaaaaaatacggttccggcggcctggtacagggcaaaaaatatatgctttctctgacctggaacgcaccaatggaagccttcaccgaaaaagatcagttcttccacggcgttggcgttgacggtgtgtatctgccgttccataaagcaaaccaattcctcggtatggaaccgctgccgacatttatcgctaatgacgtgataaaaatgcctgatgttccccgctatactgaagaatatcgcaagcatcttgtggaaatttttggttaactagagctcaggctttagaaggagttaaccatgcttaccgtaatcgcagaaatccgtactcgtcctggtcaacatcaccgtcaggcggtattggatcagtttgctaaaatcgttccaaccgtactgaaagaagaaggttgccacggctatgcgccaatggtggattgcgcagctggcgtgagtttccagtctatggcaccggattctatcgtgatgattgagcagtgggaaagcatcgcgcatcttgaagcgcatctgcaaaccccgcacatgaaggcgtatagcgaagccgtaaaaggtgacgtgctggagatgaatatccgtattctgcagccagggatttaatcctgccttgtttgcccggccatcctgaccgggcaatgttctttcctttaaacctcaatctccgccatgtcgcctttctcttgcaaccagttgcggcgatcttccgagcgtttcttcgccagcagcatatccatcatcgcgtcagtacgctgatcgtcttcatcatcgatagtcaactgcaccagacggcgagtgttcggatcaagcgtggtttcgcgcaattgcatcgggttcatttcccccagacctttaaaacgctggacgttcggcttgcctttcttgcgttttaattgctcaagtacgccctctttctcttcttccgtcagcgcgtaataaacctctttcccgagatcaatacggtagagcggtggcagtgcgacgtaaacgtgaccgtgtttcaccaacgcgcggaaatgttttacgaacaaagcgcagagcagcgtggcaatgtgcagaccatcagagtccgcatccgcgaggatacagattttgccataacgaagctggctcagatcgtcgctgtcaggatcgataccgatcgctaccgaaatatcgtgcacttcctgcgaagccagcacttcgtcggaagagacttcccaggtgttaaggatcttacctttcagtggcatgatcgcctgatattcgcgatcgcgcgcctgcttggcagatccgcctgcggagtcaccttccacaaggaacagctcggtacggttaaggtcctgcgcggtacaatcagccagtttgccaggcaacgccgggccgctggtcagctttttacgcaccacttttttggccgcacgcatacggcgctgggcgctggaaatcgccatctccgccagcagttcagccgcctgaacgttctggttcagccacaggataaaggcatctttcaccacgccagaaacgaatgccgcgcattgacgcgaagagagacgctctttcgtctgcccggcaaactgcggatcctgcatttttactgacagcacataggcgcagcgatcccagatatcttccgccgacagctttacaccgcgcggcagaatattgcggtattcacagaactcacgcatcgcgtccaacaggccctgacgcagaccattaacatgggtaccgccctgcatcgttgggataaggttgacgtagctttcggtcagcagttcaccgccttccggcagccacagtagcgcccagtccacagcttcagtatcaccagcgaaattaccgataaacggtttttccggcagcgtcggcagaccatttaccgcttccgccaggtaatcattcagaccgtcctgatagcaccagcgttgttcggtattgttgatctcatctttaaaagtgatctcaacgccagggcacaataccgctttggctttcagcacatgcgtcaggcgtgaaacagaaaatcgcgggctgtcaaagaaggtttcatccggccagaagtgcacactggtaccagtattgcgtttaccgcaagtgccgacaacctgtaaatcctgcaccttttcgccattttcaaaggcgatgttataaacctgaccatcgcggcgcacgttaacttctacgcgcttcgacagggcgttaaccaccgaaatccccacgccatgcaggccgccagagaactggtaatttttgttagagaatttaccgcctgcatgcagacggcaaagaatcagttcaaccgccggtacaccctcttccgggtgaatatccaccggcatcccgcgcccatcgtcaataacttctaacgactggtcagcatgtaaaataacgtccacgcgttttgcgtgacccgccagtgcttcatccacactgttatcaatgacttcttgccccaaatggttagggcgagtggtatcggtatacatccccggacggcggcgaaccggctcaagcccggtgagtacctcaatggcatcagcgttataagtttgcgtcatggtttaagttagtaattcgagttgatcgtcagagatggtgcagaccaagaaaatcgacgatcgggttgaaataatcttcgaagcccgtgaatgcgtggttgccgccttctatgacagtctggcggcaggaagcgtagtacgccaccgcctggcggtaatccagcacttcatctcccgtctgttgcagcagccagatcaaatccggcgcttccagcgggtcaatctgcatgactttaagatcgtaaatatggcgtgactctagcacatattgctgcccggtgtaggggttctcgttctgaccgagatagtccgtcagcagttcaaacgggcgcaccgccgggtttaccaccactgcgggcagcataaaacattgtgacaaccaggtggcgtaatatccccccagtgacgaaccgacaatacccagcgaatcaccgccatgttccaggacaatggattccagcagctctgccgcgtcggaaggatacggcggcaactgcggaatgatcatctcaacgtcagggtgatgttccgccagccagttttttaacaagctcgcttttgcagagcgcggcgagctgttgaaaccgtgtaaataaagaagcgtagacatcagtagccttctgaagcggtatcaggttggaaacgtgtgtccgccaggcgatgcacctcggtggtcagcgtgccatcagcatgtaactcgagagtacgccagccgggcgcgatggtatccagcgtaaagttggaacagtgcggcttaaactgcacacaggtcgacggcgttgccagcaggcggcgaccattccagtcgagatccagctcctgatgaatatgaccgcacagcaagtatttgacgtgcggaaacttcgccagcacggtatccagttcgcccgcgttacgcagactgtgttgatcgagccaactacaacccgcaggtagcggatgatgatgcagcagcagcaacgtatggcgttctggcgcatcggccagtttacgttccagccactcaagctgaaactcgctcagctcaccgtgcggcacgccaaacacctggctatccagcaacaggatttgccattgctcaccaataaacacgcgcttcgccggggagatacccgcatcctgtaacgcgctgtacatcgcgggctggaaatcgtggttgcccggcagccagacgcagggcgcacgaaaacttgcgatgccttcagcgaaatgctgataggccgcagaggattgatcctgcgctaaatcacctgtcgcgacaatcaggtcgaattcgtgctggtgtggccgaatcgcctccagcaccgcctggtaactctcccaggtgtttacccctaacagggcttcgtgcttttgtgcaaacaggtgagtgtcggtaatttgtaaaatcctgactctggcctcaccagccagaggaagggttaacaggctttccaaatggtgtccttaggtttcacgacgctaataaaccggaatcgccatcgctccatgtgctaaacagtatcgcaaccagtccgctaaaaactgattaatttgatgcttttcgtcgcgttgatgcaactttttattaggataatcataccgcgctttgaagcgaaaaatctgctggcttgaacacacttcagccaccatcgcgtcatgatacagacgcaccgtcattgacggaaggctccagtaactgatcgcgggcgcagtctgttctattgtcaccagggtagtgtatcgggtcgattccacaatcgtcagccgatattgtgcgtttgccacctgatagcttacagtttcgccgggtgcgtcattgcgcggtaacaaacggcgcaattgtgaaaagttcatctcgcacaggcgcatcatttcaggaaagtcaggtgtgtaacgcttcatttatgcccactcattttttaacgcttgatgatgcagctgcagccattgcaaagcgatgaccgacgctgcgttgtcgattttcccctcttctacccactggtatgcctgttcccggcttaccacatgaacgcgaatatcttcgttttcatcagccagaccgtgaataccgcttgcggtcgtggcgtccacttcgcccaccataattgacgaacgctcactggtgccccccgggcttgccaggaaacttaacaccggtttggtccgtttgactatcagtcccgcctcttcaatcgcttcgcgacgggcaacatcttccacactttcaccctcttcaatcatcccggcaaccatctccagtagccaaggggtttcgctggtgtcgtacgcggcaatccgaatctgctcaatcagcacaacttcatcacgcactgggtcaaagggtagcaagactgcggcgtgaccgcgctcaaaaatttcccgccgcacctcatgactcatttgcccgttgaatagacgatgacgaaatctataaagatctaatgaaaaaaagccgcgataaagtgtttctcgtgcaataatttctacatcgtttttgccaaatgtaacgggcaggttgtctggcttaagcattgttaatgtcctggcactaatagtgaattaaatgtgaatttcagcgacgtttgactgccgtttgagcagtcatgtgttaaattgaggcacattaacgccctatggcacgtaacgccaaccttttgcggtagcggcttctgctagaatccgcaataattttacagtttgatcgcgctaaatactgcttcaccacaaggaatgcaaatgaagaaattgctccccattcttatcggcctgagcctttctgggttcagttcgttgagccaggccgagaacctgatgcaagtttatcagcaagcacgccttagtaacccggaattgcgtaagtctgccgccgatcgtgatgctgcctttgaaaaaattaatgaagcgcgcagtccattactgccacagctaggtttaggtgcagattacacctatagcaacggctaccgcgacgcgaacggcatcaactctaacgcgaccagtgcgtccttgcagttaactcaatccatttttgatatgtcgaaatggcgtgcgttaacgctgcaggaaaaagcagcagggattcaggacgtcacgtatcagaccgatcagcaaaccttgatcctcaacaccgcgaccgcttatttcaacgtgttgaatgctattgacgttctttcctatacacaggcacaaaaagaagcgatctaccgtcaattagatcaaaccacccaacgttttaacgtgggcctggtagcgatcaccgacgtgcagaacgcccgcgcacagtacgataccgtgctggcgaacgaagtgaccgcacgtaataaccttgataacgcggtagagcagctgcgccagatcaccggtaactactatccggaactggctgcgctgaatgtcgaaaactttaaaaccgacaaaccacagccggttaacgcgctgctgaaagaagccgaaaaacgcaacctgtcgctgttacaggcacgcttgagccaggacctggcgcgcgagcaaattcgccaggcgcaggatggtcacttaccgactctggatttaacggcttctaccgggatttctgacacctcttatagcggttcgaaaacccgtggtgccgctggtacccagtatgacgatagcaatatgggccagaacaaagttggcctgagcttctcgctgccgatttatcagggcggaatggttaactcgcaggtgaaacaggcacagtacaactttgtcggtgccagcgagcaactggaaagtgcccatcgtagcgtcgtgcagaccgtgcgttcctccttcaacaacattaatgcatctatcagtagcattaacgcctacaaacaagccgtagtttccgctcaaagctcattagacgcgatggaagcgggctactcggtcggtacgcgtaccattgttgatgtgttggatgcgaccaccacgttgtacaacgccaagcaagagctggcgaatgcgcgttataactacctgattaatcagctgaatattaagtcagctctgggtacgttgaacgagcaggatctgctggcactgaacaatgcgctgagcaaaccggtttccactaatccggaaaacgttgcaccgcaaacgccggaacagaatgctattgctgatggttatgcgcctgatagcccggcaccagtcgttcagcaaacatccgcacgcactaccaccagtaacggtcataaccctttccgtaactgatgacgacgacggggcttcggccccgtctgaacgtaaggcaacgtaaagatacgggttatctgccgcattcttcccccttctcgcttcaatttcgaccagccatcctctattctgatgggtatttaccactggtcccggaagacaaaaatgaaacggacaaaatccatacgccacgcatcgttccgcaaaaactggagcgcacgccatctgacaccagtcgctctcgcggttgccactgtttttatgctggctggctgtgaaaagagtgatgaaacagtgtctctctatcaaaatgctgacgactgttcagctgcaaacccaggcaaaagcgccgaatgtaccaccgcgtacaacaatgcgctgaaagaagccgaacgtactgcgccgaaatacgccacccgtgaagactgtgttgctgaatttggtgaaggtcagtgccagcaggcaccagcccaggctggcatggcaccagaaaaccaggcgcaggcccagcaatccagcgggagtttctggatgccgctgatggccggttacatgatggggcgtctgatgggcggcggcgcgggatttgcacagcagccgctgttctcctcgaaaaacccagccagtccggcttacggtaaatataccgacgcgacgggtaaaaactatggcgcagcccagccaggccgcaccatgaccgtaccgaagacggcaatggcaccaaaaccggcgaccaccactaccgttacccgtggcggttttggtgaatctgttgccaaacaaagcactatgcagcgtagtgcaaccggtacctcttctcgttcaatgggtggctgataccgatggaaagagtcagtattaccgagcgcccggactggcgtgagaaagcccacgaatacggtttcaattttcacaccatgtacggcgagccgtactggtgtgaagatgcttactacaagttgaccctcgcccaggttgaaaagctggaagaagtcaccgccgaactgcaccagatgtgcctgaaagtggtggaaaaagtgatcgccagcgatgagctgatgaccaaattccgcattccaaaacacacctggagttttgtgcgccagtcatggctgacgcaccagccatcgctttattcgcgtcttgatctggcgtgggatggcactggtgaacctaaacttctggaaaataacgccgatacgccaacgtcactatacgaggcggcgttctttcagtggatctggctggaagatcagcttaacgccggtaacttgccggagggcagcgaccagtttaacagtctgcaagaaaaactgatcgatcgcttcgttgagctgcgtgaacagtatggcttccagttgctgcatctcacctgctgtcgcgacacggtggaagatcgcggaaccattcagtatttgcaggactgcgcaacggaagctgaaattgctactgagttcctctacatcgatgatatcgggttaggtgaaaaaggtcagttcacggatttacaggatcaggtaatttccaacctgttcaaactgtatccgtgggaatttatgttgcgtgagatgttctcaaccaagctggaggatgcaggcgtacgctggctggaaccggcgtggaagagcattatctccaacaaggcacttctaccgctactgtgggagatgttcccgaatcacccgaacctgctgcccgcttattttgcggaagatgatcatccgcaaatggaaaaatatgtggttaaaccgatcttctcccgtgaaggcgcaaacgtgtcgatcattgagaacggcaaaaccattgaagcagcggaaggtccgtatggcgaagaagggatgattgttcagcaattccacccgttaccgaaattcggcgacagctatatgctgattggtagctggctggtgaacgatcaacccgccggaattggcattcgtgaagaccgtgcattgatcacccaggatatgtctcggttttatccacatatttttgttgaataagccacgataccggatggcactcgccatccggtaattgttagcctatctgcaccgacagcatactcaggctgcccatttctataccctcaaccggaatggtaattggctcctgcccatcccacgcacctaacacatacaacaacggcaaataatgctctggcgttgggttcgataacgtgccaccttcatggtcgaggtaattcaccagaggatgttgttccactggcccttgccacgtcagattcgctttcacatactcattaaacgacgtcgcccacggatacggtgaactatcaccgtgccacttcactgtgcgcaggttatgcaccacgttaccgctggcgaccaacattattccttcatctcgcagcgctgccagtttgcgccccatttcgaaatgccaggcggcaggtttgctactgtcgatactcaactgcaccatcgggatatcagcgtcaggatacatcttaatcagcacgccccacgagccgtggtcaaagccccaggcttctttatccagcgtcaccgggatcggcgctaacagctcaaccagacgctgtgccagcgcaggcgaacccggagcaggataatgcgtatcgtacagcgcctgcgggaagccaccaaagtcatgaatcgtgggcggcgtctccatcgcggtcactcctgttccacgggtaaaccagtgagccgaaaccaccacaatcgcttgcgggcgtggcaatgtcatccccaacttctgccagctgcgggtatacaaattatcttccagcacgttcatcggactaccgtgacctaaaaacaatgctggcatacgtgttgaagacatgatgatatccttaactaaaggtgtcattttgatatcctcacaatacgcttgttcggcggagtaagaacccggataacaatgatgatgatcatcagttattttgacgatctgcctgaaggtgaagatttataaggagttgtcgatgtcagtacctctcattctgaccatactggcgggggcagccacgtttattggcgcgtttctcggcgttctcgggcaaaaaccctcgaaccgcttactggcgttttcgctaggttttgcggcggggatcatgttgctcatctcattaatggaaatgcttcctgccgcactagcagctgaaggaatgtcgcctgtgttgggttatggaatgtttatcttcggtctgcttggctattttggcctggaccgcatgttgccacatgctcatccgcaggatttaatgcaaaaatcggtgcagccgttgccaaaatcgatcaagcgcacagccattctgctcactctcggcatcagtctgcataacttcccggaagggattgccacctttgtcacggcgagcagcaacctggagctgggatttggcatcgcactggccgtcgcgttgcacaatatccctgaaggtctggcagtggcaggcccggtttatgcggcaacggggtctaaacgcaccgcgattctgtgggcggggatttctggactagcagaaattcttggtggtgtgctggcgtggttaatcctcggtagcatgatttccccggtggtcatggcggcaatcatggcggcggttgcaggaattatggtggcgctctcggttgatgaattaatgccgctcgccaaagagattgaccctaataataaccccagctatggcgtactatgtggaatgtcagtgatgggattcagtttagtgctgctacaaacggcgggaattggttaaaaacaacatcagaagttgtccagcgcatggacaacttctgccagcttcacgaaagccttattctaccttttcggctgtctcttctctcgtactgtttaagtatttgttccgcgcttcaagcagtgcgtctctgtcctggcgaaacgcccgacaataacgtttcaaatgcaggaaataacccaccacaaccagagcaatcaatacaatccagtaccaggcgataaacatccttttacccttaatatttaacaatactaaacatttagcgtataaatttcacatatcctttttcggatatattcatatggtcgcataataacggaacaattatatgattttgatcataatgaaaaagaatgcctgatattaatgaaattttctcatagaaagagaagcggaattaacatcttgcatagcagggaaaaataaaaaccgaagcctgctacaacttcggtttcttgattaaggcagtaaattaagcagcggttttcagctggctttacgctcatgtgcctgacggtatgccaccaggtcttcaatagtcacgagcgccatattgtgtttattggcaaactcaatacactctggtgcacgcgccatcgtgccatcgtcattagtcagctcacacagtacaccagccggtttaaagcctgccagcgtcatcagatcaatagttgcttcagtatgaccgccacgcgtcagtacaccacctgcctgagcgcgaagtgggaaaacgtggccaggacgattcagatctgacggttttgcgccatcggcaatcgctgcgcgaacggtcgtaatacggtcagcggcagaaacaccggtagtcacaccttcagctgcttcaatggtcacggtaaaaccggtgccataggcgctggtgttattttctaccatcattggcagatcgagttgtttacggcgatcttcagtaatgcacaggcaaacaataccgctaccgtggcgaatggtcagcgccatctgctcaacagtcatggtttctgccgggaagatcatatcaccttcgttttcacggtcttcatcatcaagcaccattacaccgcgtccttcacgcagcgcagccagtgcattttcaacacgttcgaaaggcgtaccaaaagaggaaagtagcgtctgattcatggtaaaaaaacctcactaaaattatggttaccagaatcagggcagtcttaggagtggcggcatatagccaaaataacgtgagcgggtccatgcccgacagaatcgttactctctcccatccggactctaaccgtcggccccggaattacaccggatctgctgtcctttgagttcgcacccaaagcgctcgcgggctttcaactgagttgatttaccgccggtggggaatttcgccccgccctgagaataagcggattcactataacgctaatgattagcggcagcaacgcatagcttcacataattctggtttatgacttacccttatcgcactacaatggcactcaacacctatcagtacagggaaactacaatgattgacccgaaaaaaattgagcaaatcgctcgccaggttcacgaatcaatgcctaaaggaatcagggagttcggggaagatgtggagaaaaaaatccgccaaaccctacaagcgcagctgacgcgcctcgaccttgtaagccgtgaagagttcgacgtccaaacgcaagtcctgttacggactcgtgaaaaactggcgctgcttgaacaaagaatcagcgaactggaaaatcgcagtactgagatcaaaaagcagccagatccagagactctccccccaacgctgtaaacattcgtctttaatgcactgtaaattatgaattaatcctctaatttatagtgctttctattaccttatcgcgtaatcccattcagaaaaccatcacaaaaatgaatgagtacaattgaaagtataattgcaatgtattttttaagttttacttaatcgatatttagataaactaattttataaaaaacacaaaataaaatatcatatttcaatgattagtagtccttaaataacagttactaatcattctcttttctacttatctttatataaaggaatattatgtccgcttttaaaaagtcacttcttgttgctggcgtagcaatgattctttccaataacgtgtttgctgatgaaggtcacggtattgttaaatttaaaggtgaagttatctctgctccatgttctattaaaccaggtgacgaagatttaactgtaaatctgggtgaagtagcagataccgtactgaaaagcgatcagaaatctttggctgaacctttcactattcacctgcaggactgcatgctgagtcagggtggaactacttattcaaaagcgaaggttactttcactacagcaaataccatgacgggtcagtctgatcttctgaaaaataccaaagaaactgaaatcggcggcgccactggcgttggcgtacgtattctggacagccagagcggcgaagtaactttaggtactccggtagtaattacgttcaacaataccaacagctatcaggaactgaatttcaaagctcgtatggaatccccaagcaaagatgccaccccgggcaacgtttacgctcaggctgactacaagattgcttacgagtaatcgcatttggccgggttcgcccggccacatcattaacggattaatgataagtggatcagatgtataaaaaattaaaattaaccacaataagcgaattgattaaaaatatttattgttcattatccgttattagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccagttatcatcattggttgtgcgtcagcttatgccgttgaattcaacaaagatttaatcgaagccgaagatcgtgaaaacgttaacctttcccaatttgaaactgatggccaattacccgtcggcaaatattcactaagcactctgattaataataagaggacgccaatccaccttgacctccaatgggtattaattgataaccaaactgcagtttgcgtgacaccagagcaattaacattattaggatttactgatgaatttattgaaaaaactcagcaaaacctgatcgatggttgttaccctatcgaaaaagaaaaacaaattacaacttatctcgataaagggaaaatgcaattatccatatctgcacctcaggcatggttaaaatacaaagatgcaaactggacgcctcctgaactttggaatcatggtattgctggggcatttcttgactacaatttatatgcctctcattatgcaccacatcagggcgataattcgcaaaatataagttcctatgggcaggctggggttaatcttggggcctggcgcctgcgtactgattaccagtacgatcagtcatttaacaatggcaaaagccaggcgaccaacctggattttccgcgtatttatttgtttcgcccaatcccagcaatgaatgcaaaactaactataggtcaatacgatactgaatcctctattttcgactctttccatttttctggcatttcgttgaaaagcgatgagaatatgttaccgccagacctacgtggttacgcaccgcaaatcacgggtgtcgcacaaacgaatgcaaaggtcactgtctcacagaacaaccgtattatttatcaagaaaatgttcctccaggcccatttgctattaccaatttattcaatacattacaggggcaacttgacgtcaaggttgaagaagaggacggacgcgttacgcaatggcaagttgcatctaatagtattccttatctgacgcgtaaagggcagattcgctacaccactgctatgggtaaaccgaccagcgttggtggtgattccttacaacaacccttcttctggactggtgaattctcatggggttggctgaacaatgtatccctgtatggtggttcagttttaacaaaccgtgattatcaatctctggctgccggcgttggttttaatcttaactcattaggttcattatcttttgatgtcacacgatctgatgctcagttgcataatcaggataaagaaacgggttatagctaccgcgctaactattcaaaacgttttgaatctaccggtagccagctcactttcgctggttaccgtttctctgataaaaactttgtgacaatgaatgaatatatcaatgacactaaccattacacgaattatcagaatgaaaaagagagttatattgtcacgtttaaccagtatcttgaatcattaaggttaaatacatacgtaagtttggctcgtaatacttactgggacgccagcagtaatgtgaattattcattatcacttagccgcgattttgatatcgggccattaaaaaacgtctccacttctctaacatttagccgaataaactgggaagaagacaaccaggatcaactgtacctaaatatttcgattccctggggaactagtagaacattgagctatggtatgcaacgaaatcaggataatgagatttcgcatactgcttcgtggtatgactcttccgatcgaaataattcctggagcgtttctgcttcaggcgacaatgatgaattcaaagatatgaaagcgtcactacgcgccagttatcagcataataccgagaacggtcgactctacctctccggtacatcacagcgagacagttattattctctgaatgccagttggaatggttcattcactgcgactcgccacggtgccgctttccacgactatagcggtagtgctgactcgcgttttatgatcgacgcagacggcactgaagatattccgttgaacaataaacgcgcggtaactaatcggtatggcatcggagttattccatcagtcagcagttacataacaacatcattaagtgttgatacccgaaatctgccagaaaatgtggatatcgaaaactcggttatcaccaccaccttaaccgagggtgctattggctacgccaaacttgatacccgcaagggctaccaaatcataggggttattcgcctggcagatggtagtcatccaccactggggattagcgtaaaagatgaaaccagccacaaagaattaggactggttgctgatggcggctttgtatacctcaacggcattcaggatgataacaaacttgctttacgctggggtgacaaatcttgttttattcaaccacccaatagcagcaacttaaccaccggaacggctattttaccgtgtattagccaaaattaattcaggatgaaactaatgcgctacttaaatacaaagaatatcattgcagcaggagtattactctcctgtatgagcagcattgcctggggtgccatcatcccggatcgtacccgtatcataatgaatgagtcagataaaggcgaagcattaaaacttactaatcaaagtaaaaacctgccctatctggcccaaacatggatagaagatacgaaaggcaataaatcgcgtgactttattgtcactgttcctccaatggtgcgtttaaatcccagtgagcaaattcaaataagaatgataactcaggaaaaaattgctcaacttcctaaagacagagaaacgctcttctattttaacgtgcgagaaataccgcccaaaacagataaaaaaaatgtgatgcaagtcactatgcagcacgcattgaaactattctggcggccaaaagccattgaattagaagacgatggggtaatgacttacgaaaaagttgaaatcattcgtagaaatgacggttcgatccgctttaacaataagatgccttatcacgttacgctgggttatatcggaacaaatggggtaacgatgttaccacaaacgcaaagcttaatggtaaccccttttagctatgcaaatacgcagtttaaaaatgttccgtcaacttttcaggtgggttatatcaatgactttggtggattaagtttttatgaaataaactgccctgtagtaaataacatttgtaatatttctgtagccaaccgagatcaataatatgcgctacttgttaattgttattactttttttatgggttttagttcattacctgcatgggcaatggactgctatgctgaacatgaaggtggaaataccgttgtcattggttacgtaccaagaatctctatccccagcgatggtaaaaaaggtgataaaatctggcaaagcagtgaatattttatgaatgttttctgtaataatgcactaccaggcccatctccaggagaagaatacccatctgcatgggcaaatataatgatgttgttagcatcaggtcaagacttttataatcaaaactcttatactttcggtgtaacttataatggggttgattatgattctacatctccactacctattgcagcacctgtatgtattgatataaagggagccggaaccttcgggaatggctacaaaaagcccgcagtctgtagtggcggtcctgaaccgcaattatcagtaacttttccagtacgagtgcagctatatattaagctagctaaaaatgccaataaagtaaataaaaaacttgtattacctgacgaatatatagcacttgaatttaaaggtatgagcggagcaggtgctatagaagtagataaaaatctgaccttcaggattcgcggattaaataacattcatgtccttgactgctttgttaatgttgatctggaaccagctgatggcgttgtcgactttggtaaaataaattcccgaacaattaaaaataccagcgtgagtgagacgtttagcgtagtcatgaccaaagatccgggtgcggcctgtactgagcagtttaatattttagggagttttttcactacggatattttgagtgattatagccatctggatataggtaatggtctgctattgaagatatttcataacgatggaacagcaacggaatttaaccgcttctcacaatttgcttctttttcatcgtctagtgcgccttcggtcaccgcaccattcagggcagaactgagtgcgaacccggcagaaacggttgttgagggaccgtttagtaaagacgtaatcctgaaaatcacctataactagtatctaatacaaacactaaaacgggccatcaggcccgttatatcagtgctctaactccagctctcttgcctgcatcatctgttgacaataccaggcataacgtgcgcaaaaccaggttctatgttcttcatccatgttaccagtaacggccagaatatcgaccgggcgaccttctgcgtgcattctggcaaaactacgcgccaggaaatcgaaattatttaaagaattaagactatgatccataagcacatcctccggttatcgcataccttttaaggccatatgctttttctgatttcagtattccccaatcagtgtagtgcctttaaacataacgtgcgtaaatatattgtccccgatcacactttttagtgaaaaataaaaaaccatattaaaagactttctcttccagaacttctctaacctgtgttattattaacacagataaatgtaagcaaggaaactattacaaagtaaatattgcgtcactaaatggacattggagtgatatatgattttattcgccgactataacaccccttatcttttcgctatttcctttgtactgttgatcggcctgttagaaatttttgcgcttatctgcggtcacatgctctccggtgctcttgatgcacatcttgaccattatgattctataaccacaggtcatattagccaggcacttcattatctcaatattggaagattgccagctctcgtcgttctctgcttactggctggtttttttggtcttattggcatcctgttgcagcatgcctgcatcatggtctggcaatcaccactgtcgaacctgttcgtggttcctgtcagtttactgtttacgattattgcggtgcattataccggtaaaatagttgcgccctggattccacgcgaccatagttcagctattacagaagaagaatatattggtagcatggcgttaattaccggtcatcaagccacttcaggtaatccctgcgaaggaaaactcaccgatcaatttggccaaatacattatttactactggagcctgaagaaggaaaaattttcactaaaggagacaaagtgttaattatttgccgactttctgcaacgcgatatttggcggaaaataatccctggccccaaatattgtaatttattaatcaaaaggaaatttaataatggatgatattgttaattctgtgccctcctggatgtttaccgcaattattgccgtatgcattctgtttattattggaattattttcgccaggctctatcgtcgcgcttcggcagagcaagcttttgttcgtactggtttaggtgggcaaaaagtggtaatgagcggtggcgcaatcgtgatgccgatctttcatgaaataatccccatcaatatgaatactctgaagctggaagtcagccgctcaaccattgatagcctgattacgaaagatcgtatgcgcgtcgatgtagtagtcgctttctttgtgcgggtaaaaccttcagtagaagggattgccaccgctgcccagacgctggggcaacgcaccctgtcgcctgaagacttacgtatgttggttgaagataaatttgtcgatgccctccgtgcaacagctgcgcaaatgaccatgcatgagttacaggatacccgcgagaactttgtgcagggggtgcaaaatacagtggcagaagacctgtcgaaaaacggtctggaactggagagcgtttcacttaccaactttaaccagacctcgaaagaacatttcaatccgaacaatgcctttgacgccgaaggtttaaccaaactgactcaggaaacagagcgccgtcgccgcgaacgtaacgaagttgaacaggatgtagaagttgcggtgcgtgaaaaaaatcgcgatgcgctatcgcgcaagctggagattgaacagcaagaagcgtttatgacgcttgagcaggagcagcaggttaaaacccgtactgccgaacagaatgcacgtattgcggcttttgaagctgaacgtcgtcgtgaagcagagcagacacgaattctggctgaacgacagattcaggaaacagaaatcgaccgcgaacaggccgtccgctcaagaaaggttgaagctgaacgtgaagttcgcattaaagagatcgaacagcagcaggtcaccgaaatcgctaaccagacgaaatcgatcgctattgccgccaaatcggaacaacagtcccaggcagaagcgcgtgctaatctcgcacttgcagaagcggtaagcgcccaacaaaacgtagaaaccactcgccagactgccgaagccgatcgtgctaaacaagttgccctaatcgctgccgcgcaggatgcagaaaccaaagcggttgaactgaccgtgcgggcgaaagcagaaaaagaagccgcagagatgcaggcggcggctatcgttgagttagccgaagctacacgtaaaaagggtctggcggaagcagaagcacaacgtgcgctgaacgatgctatcaacgtactttctgatgaacaaaccagccttaaattcaaactggccttgttgcaggcgctgcctgcggtaatagagaaatccgttgagccgatgaagtcaatcgacggtatcaagattattcaggtcgatggtctgaatcgtggcggcgctgcgggtgatgcaaacacgggtaatgtggggggcggaaacctggcggaacaagcattatcagccgctctctcttaccgcacacaggcaccgctgattgactccttgctcaatgaaattggcgtttcaggcggctcactggcggcattgacttcacccttaacctcaacaactcccgtcgaagaaaaagcagagtaaaccctcttccaggaataatccctggcccaaaaagccggggattttttatatctgcgttccgctaaaaagtgcaaatgatcaggttgttgcagcattttgcgtgacggctcggggaaggcaaaactgcatcagagaaagcattgcgtggggtctggcgctcatcaacaatcggggagtcagcagggggctgaaacgggaaagcccctcccgaagaagggggccttacagaaggaaagggttatgatgaagctcgtcatcatactgattgtgttgttactcgtaagtttcgcagcttattaacagccaatcagaggggggagaaatcctccctcacccttgttcctttactttaggttgaaaaaaaatcagcgtcaagaaggtttcattaacacatatccctggcccaaaaagccggggattttttatatctgcgttccgctaaaaggtgcaaatgctcaggacgttgcagcgttttgcgtgaccgctcggggaaggcaaaattgcctctgggaaagcattgcgcggggtccggcgctcatcaacaatcggggggcagcaaggggctgaaacgggaaagcccctcccgaagaaggggccttgtataaggaaagggttatgatgaagctcgtcatcatactggttgtgttgttactgttaagtttcccgacttactaacaactcatcagaggggggagaaatcctcccttacccttgttcctttactctaggttgaaaaaacaacagcgtcaataggcctgccatgtacgaagcgagatctgtgaaccgctttccggttagccttttttatcctgttggatcttcttgatgatgttggtcgtcgagcaaccgtcttcaaagttgagcaccaacacttcgccaccgttggcccagacttctttactcccggcaatctcttctggtttatagtcgccgcctttcaccagcagatctggcaagatcccggcgatcaagcgctgcggcgtgtcctcttcaaacgacactacccagtcgaccgcttccagtgcgcccagcacaatcatacgctgttcgagtgggtttaccgggcgggaatcccctttcagccgtttggtggaggcatcgctgttgacggcaacaatcaagcggtcacccagcttgcgggcatttgccagataagagacgtgcccggcgtgcaggatgtcaaagacaccgttggtcatcaccactttttcaccacgtttacgcgctgccgctacggccagcttcagttcctcttcggtcatcacgccaaagcctgtatctgcacgtccacgtacagcattttccagctcgatcggcgaaaccgtggaggttcccagtttgccgaccaccacgccagccgccgcattggcaaagaagcaggcttcttccagcgaattacccgctgccagcgttgccgccaggacgccaatcaccgtgtcgcccgcaccggtaacgtcatacacttcctgcgcttgggttggcatatgcagcggcgctttacccggttgcagcagcgacataccctgttcggaacgggtcactaacagagccgagagttcgtaatcggcaatcagtttcatgccgcgctcaacaatctcttcttcggtcttacatttaccgacaacagcttcaaattccgagagattcggcgttaacagcgtagcgccgcggtagcgctcaaaatcggtaccttttggatcaatcagcaccggaacacccgctttacgcgccagttggatcatctgctgtacgcttgccagcgcacctttggcgtagtcagaaagcaccagcgcgccaatcgaactcagcgcctgattaatccgctcgtgcagcggctgcggatcaacaccttcgaaaccttcttcaaaatccagacggatcagctgttggttgcgggaaagtacccgtaatttggtaatggtcggatgcgtcggtacagaaacgaagtcgcatttgacgttgacgtcggccagagatttactcagcgcgcgcgctgcatcgtcaatgcccgtcaacccgaccaggcgtgcattagcaccgagagaagcgatattcatcgccacgttagccgcgccgcccggacgttcttcgatggtattcactttaaccacgggcaccggcgcttccggcgagatacgactggtggggccgtaccagtaacgatccagcatcacatcaccaaccaccatcactcctgcacgttcaaactctggcagcgttactttcattcctgtctcctgagagattcaaaatttgcgcgcgataataccatacttcattcttccaccagccacttctgccagcttgcccgcaccagttcacgctctgcggtgaagcaatcctccgacacatggcccggcaattcctgtaatgccagatgatgaagttcatcgcgaagcgtagtgtaagcacgggtcagcgccatcgcttcctgctcttccataatgtcgttttgcgccagtagttccagaatacgcacgttgtctgaccagcgcgttaacttcggtttttcatgagcgtagcgcaacaccagatattgggtaataaattcgatatcggtaattcccccttcatcagctttgatatcaaagcgatcgcgatgtttattgccgagatgagcgcgcattttctcgcgcatttcccgcacttccgtttgcagagttttaccttcacgcggcagcgtcataatctcgcgacgcactgcgtcaaagtgcgcggtgagctgcggatcgccgtacactacacgcgcacgcaccagcgcctgatgttcccacgtccaggcctcgtttttctgataatcggcaaatgcttctgcggatgtcaccagcattcccgccgccccggacggacgcagtcgagcatccacttcatacaaaatgccggaagaggtacgcgtactgaacagatgcataatgcgttgcgccagacgcagataaaactgccgcccgtcgatttcccgctcaccgtcagtcatcgcatccattgggcaatcatggaggaagataaggtcaagatcggaactgtagcctaactcccagccgcccagcttgccgtagccgaccaccgcaaaaccacgcccttcgcgttcgttcaggtgattcggcttaccgtagcgggcaaccatttgaacccacgcctgctgaacgacggcatctatcatggcttccgccagccaggttaagtgatcgctcactttcatcaccggtagcgtaccggcgatatccgctgcggcgatgcgtaacagctgcgcctgtttgaactgacgcagcgcctcaagctgttgctcttcgtcatcttccggcacgcgcagcaaatactggcgcaactcatcgcggtaggcatcggtcgccgtcggctggtaaagggtgtttggatcgagcaattcatccagcaataatggataacgcgccagctggctggcaatcatcggcgacgcggcacacagagaaatcaaatgtttaagcgccgcggggaattcactgagcaattctaaataggtggtgcgggtaacaatccccaccagcaaggcggtaatgcgcgacagcgtaacggcagcgtcttcacgcgcacagacatcacttagcagatgcggcatcagatggtcgagcacctgacgtcctcgcggcccgatggtgcgcttatccagctctttgcggaaatcggcaatcagcgttagcacctgtttgcgatcatcctcgctaagatgcgccagcactggcgtagtgtcatcttcctgcaacgcatcctgccacagctcacgccactgttccgacagcgactcttcctgagtttcactttcatcgtcgccaatcaattcattaaacacccggcgcacattggtcatatgtgcggtcagcgccccggtcagttgcggccagtcagcaaagtccatcgcccacgccagccgcgcacgattaagctcatcagaaggaagcgtctgggtttgttcgtcgttaatgctttgcagcaggttttccagacgccgcaggaacagatacgccactcgcaattgttcagcatcgttttcagaaagcagatgcagctcggcaatggcgctgagcgttggcagtaaagagcgcgattgcagcgacggttcgcgtccgccgcgaatgagctggaacacctgaacgataaattcaatttcgcgaatgccgcctgcgccgagtttgatattgtcggtcaaaccacgtcgacgcacttcacgggcaatcatccctttcatgttgcgcagcgactgaatcacgctgaaatcgatgtaacgacggaaaacaaacgggcgcagcatcgcacgcaactcgttagcatagacgccttcgctatcgcccataatccgcgccttgaccatcgcgtaacgctcccagtcgcgcccctgctcctggtaataatcttccaacgcggcaaagctcagcaccagcgggccactttcgccaaacggacgcagccgcatatccacgcgatagacgaagccatcctgcgttggttgatccagcactttaatcagccgctgccccatgcgggtaaaaaactgcgcgttatccagttcccggcgtccaccctgcgtacaaccatgttccggccaggcaaaaatcagatcgatatcagaggagaaattcagctccccaccgcccagcttacccatgcctaaaatcagcagcggttgcgcttcgccctgcgcattgcacggcgttccccactcgcggcagcaggcgtcatacagccagtcacgcgccgcaacaatcagcgtctccgccagatagctgagctgctgcaatatgctctcttcagtaaccagtgccagcgtttgcgcccaggcgatgcgcaccataatgcgccgccggaatagccgcagctcgcgcattaacccggcttcgtcactcacattacagagcgcctcctgcaaccatgccgcgtaatgctgccattcgtcggcctgcggcggttggctttccagttccgtcagccactctggatgcgcaatcacgctgtcctgcacaaaatcactaaaagtaagtactgacttcgcctgtgcgctaagtgattcctcggctaaaggctctggcagccgctcaacaacggtctgccagtactgctgtaacggtgaagagagcggcttcataagcgattttatccttgcctgattaacgttttccgctgtgcaaccagaacggttcctgattgtttgcctcattacggaaatgttcaatttcgatgcgttgcccggtcgcaatagcgtgatgcagcccctgccagttctccagccaggcttgcgcgacgacaggatcatagtaacccgccagcaacagtattgagtcaatatcacgcgtcaggcgtggcaactggtcacggtagcgatcgcctaacggctggcagaaaacgcttttcagttcagcggcatggcgggaaagatggatatcggcaaagcgtttgaaggagtcgctgattttgccctgcgctttggcatctaaaaatggctgccatgctttgcttaccaaccattcggtcaacgccagcttcgccattgccgtttcggtagagtagaccgccgtcacggcagacaccgcagaagcaatggtcgcctcgcattgagtcagcagatcacgtaagtgagtgctcgctttacgcggcacaataccaccgaacagcatcagcgtatgacggaccaggctaatggctgccagcacctgttctttcgccgcatcgttgccgcgtacccacagttcttcatgatactgccattgcgctaacgccagctcgagcgccgcttccagcccctgttccacatcggcttttgccgcaacatgcaaaatggtggtcggtttgatttcacgcgccggattgccctgcgccagatgatagccacgcgccgctttgctcaggctgccctggcgtaatccggtttgcgataccagttggttcgccagtttcagcaccgcgcgcgtgtcgccgctaagcagttccagttccagctcacagataggttcagcaaattcacccgctttcacttccccctggtcgagggcgatttcaatttggctaccatcgaccgccaccagccatttttcgcgataaaaatcggtgctgaacagcggctgcacgcgggaggcgagatcggcgggcaattcgccgttcggccagacttccgtcggtaactgcgccaggtcgagcgtcggttcgctcaacgccacgttatattccgggcgctgatgtaagccgcctgtcactcttcctgcaactttcatggtcatctcatagcgaccgttttcgccacgaatacgtaagcccatatcgtgcccacgcagccagttatccggcgtttcgtagtaaatattcagcaactgcacggggtcatggtgctcgccgcccagcgtattgagatggtcacgcaacgcctcaacggcactgtgattaacaataaactttaattcgatttcctgagccatggcctttacttatcggttatgtcacataagtgacgatgaacggcgaacttaatgcgatcttttttgtcagtagatagtattttgcgccaaattgccatgcaacgggcaatttgacgggcgtaaaagtttgaagcagtggcaagacctgacacagaggattccgattgatgtcgaatgctttgcgtagcgacactgatgccactactatcgttccactttccatgacaataacgacagcctgatgccaaaattacgcctgatcggattaactttactcgcacttagcgcgactgccgtctcacacgctgaagaaacgcgctatgtttccgacgaactgaatacctgggtccgcagcggtccgggagatcattatcgcctcgtgggcacggttaacgccggcgaggaagtgaccttattacaaactgacgccaacaccaattatgcccaggtgaaagacagctctggccgtaccgcctggatcccgttgaaacaacttagcactgagccaagcctgcgctcccgtgtgccagatctggaaaatcaggtcaaaaccctgaccgataaactcaccaatatcgataacacctggaatcagcgcaccgcagaaatgcagcaaaaagtggcgcagagcgacagcgtgatcaacgggttaaaagaagaaaatcagaaactgaaaaacgagctgattgtcgcgcagaaaaaggtcgatgccgccagcgtacagctggatgacaaacagcgcaccatcatcatgcaatggtttatgtatggcggtggcgtgctggggcttggcttgctgctcggtctggtactgccgcacctgatcccaagccgcaaacgcaaagatcgctggatgaactaaatcgccttcttcgttgcactgtcttattattaggaattgtgtatttgacgaagggatgatggcgtgaagatttatctggtcggtggtgctgttcgggatgcattgttagggctaccggtcaaagacagagattgggtggtggtcggcagtacgccacaggagatgctcgacgcgggctaccagcaggtaggccgcgattttcctgtgtttctgcatccgcaaacgcatgaagagtatgcgctggcacgtaccgaacggaaatccggttccggttacaccggttttacttgctatgccgcaccggatgtcacgctggaagatgatcttaagcgtcgcgatctgaccattaatgcgctggcccaggacgataacggcgagattatcgacccgtacaacggtctgggcgatctgcaaaatcgtctgttgcgccatgtttcccccgcttttggcgaagatccgttacgcgtattgcgcgtggcgcgttttgctgcgcgttatgcccacctcggttttcgtattgccgatgaaactctggcgttgatgcgcgagatgacccatgcgggtgaactggaacacctgacgcctgaacgggtatggaaagagacggaaagcgccctcaccacccgcaatccacaggtgttcttccaggtactgcgcgattgcggcgcactgcgcgttttattcccggaaattgacgcactgtttggcgttccggcccctgccaagtggcatccggaaatcgatacgggtattcataccttaatgacgctctcaatggcggcgatgctgagtccgcaggtcgatgtccgtttcgcaactttatgccacgatctcggtaaagggctgacgccgccagaactctggccgcgtcatcatggtcatggcccggcgggtgttaagttagtggaacaactatgccagcgtctgcgcgtgccaaatgaaattcgcgatttagccagactggtggctgagtttcacgatctcatccacaccttcccaatgctgaacccaaaaaccatcgtcaaattatttgattccatcgatgcctggcgtaaaccgcagcgtgtcgagcaactggcgctgaccagcgaggctgacgtgcgcggcagaaccggttttgaatcagcggactacccgcaaggccgctggttgcgcgaagcctgggaagtggcgcagtcagtgccgacaaaagccgtcgttgaagcgggatttaaaggtgtggagattcgcgaggagctgacccgacggcggattgcggcggtagccagctggaaggaacaacgttgcccaaagcctgaatgagtattgggcattttgccggatgcggcgtaaacgccttatccggctacatgtcaacgacagttgtaggcctgataagacgcgcaagcgtcgcatcaggcgttgattgccggatgcggcgtgaacgccttattcggcctacgcaatcgttgacaacgccaagcatccgacactattcctcaattaaaagaacacgacatacaccgcagccgccacaataaagcgataaatggcgaacgggataaacgaaatgcgcttaatcaattgcaggaaggttttaatcgctatcagcgccaccacaaaagcggtgataaacccaacggcaaacatcgggatatcgccgcttgtcaggaagccccagcttttgtagagatcgagcgccgttgcgcccatcatcatcggcaccgccagcaggaacgaaaactcggaagcagcgtaacggctcacccccatcagcatcccacctgaaatggtcgccccggaacgggagaaacccggccacagcgccagacactggaaacagccaatcataaatgcctgacgataggtcatatcatcaagacccggcgcacgcggctctttcggcttcaggcattcggcggcaatcagcaacaaaccgccaacgaccagcgcatacatcacatttatcgggttaaacaatgacttaatcgtgtcgtggaacaacagccccaataccaccgccggaatcatccccagcaaaatgtggatcagcgttaaacgacctttgctttcaccttcgtgctgcaacgggcggccaaagtggatgccaatcaggccaaacagacgccgccagaacatcactactaccgccagaattgatcctaactggatcacaacttcaaaggttttcgccgtgtcgccctcaaaccccaacaagtgaccgacaataatcatatggcccgtgctggataccggcagaaattctgtcaatccttcgaccacacccaatattgccgctatcagcagcgagtgcatatcgctcatcaataaacccctaaattattaaaatgtaccgcttgtccgaactactgcgtatgaccaggttataaccgtttggtttaacagctgtaaaattaattattttctttcagattattgccacgctcaatgattacgccaacattcgccgcccgcgccactgcgcctggcttgctgagtttgatacgcacccacggcgagttgaagcgtgctaacagcagctccgccacctcttcagccacgcgttccaccagcgcaaaacgcgccccctcgacgtggctgaccaccgtttctgcaatgtcagcgtaactgaggcaatccgccacatcatcacttttcgccgctttacggttatcccacgccatttcgatatcgaacactaacttctgttcgatggtctgttcccagtcgtaaacaccaatagtggtgattaccgaaagttgctctataaatacaatatccatcacgtcctgcctgctttttggctaaccggataccacttccggcgaaatgtgcgtattatccacagattcatcgttgaacacgaattttcaaaacggaacagcttatgagtgcaatcgcgcctggaatgatcctcatcgcgtacctctgcggctccatttccagtgccattctggtttgccgcttgtgtgggctgcccgatccgcgaaccagcggctccggcaatccaggcgcaaccaatgtgttacgtatcggtggcaagggagcagccgtagcagtactgattttcgacgttctgaaaggaatgttgcccgtctggggcgcgtatgaattaggtgtcagccccttctggctaggcttaattgccatcgccgcctgtcttggacacatctggcccgttttcttcggatttaaaggaggaaaaggcgttgctaccgcttttggtgccatcgcacccattggctgggatctcaccggagtaatggcgggaacctggttactgaccgtgctattgagcggatactcgtcgctgggagcgattgtcagtgcactgattgctccgttttatgtctggtggtttaagccacaattcaccttcccggtttcgatgctctcttgcctgatcctgctgcgtcatcatgacaacatccaacgtctgtggcgtcgtcaggagacaaaaatctggacgaaattcaaaagaaagcgcgaaaaggatcccgagtgatttctggtggatctacatgacctgatagccttcatcgggcttgcccagccgttgctggcaccatgccgccagaaattccacgcagacacgtaatttcatgctgcgatagagcggctcccggtaaacagcccagatattggcgctttgtgcatactctggcaatacttgcaccagtttgccactctccagaaacggcaacacatcccactcggaacgcagcataatccctttgccctccagcgcccattgcagcacaatctcgccgctattggaggaaagatgcccgcttaccttcaccgattttttctcctgaccgttccccaactcccatattccatgggtcatatcgcgctctttggtcaccagacagtcatgacgacttaattcctgtagggattgtggctgcggatatttttgcagatactcaggtgctgcgcataatattcttttattttttgtcaaaagatgcgcaatataataatcaggaatttcgtcattaatacgaatatccagatcaatattatcctgcactaaatcaatttgccgatcgaacaattcaaaatgcacctgtaactcaggataattgcgcatcagttcggtaatagctggcgcaatatggctgcgcccaaaaccaaaactgcaaccaatacgaatcatcccctccgggcgcgttttgatttgcgtgacgtcatcgaccagtcgctgatattgggtgaggatttccaacgcatgttcgtaacaacgttggccactttcagtcagcgccacgccgcgagcggagcggttcagcagcgttgttgccagcgtattttcaaggatttggatccgcttggtgacaaatgcaggcgtctgcccaagcgtcgccgctgcggcgctaaaactcccgctgtgaacgatttctaccagtacctgcaagtctttggctaaaggccagctattcagcatcgttaattatccgcagttgtgataagcgcagtgtatttcgcaaaacattgccattccctgctctggcgcaatattcattcttattttcgcgttgattcacgaactgttaattacatattcacggtggcaaaaaatataaaaccacatttttagtggtagtttgtggcggtgaatttttccagacaaatacaaaaactggagttgccatgatgagcgaaagtaataagcaacaggcagtgaataagttgacagagattgtcgctaactttaccgccatgatttctacccgaatgcctgatgacgtggtggataaactaaaacagctaaaggatgccgaaacgtcgtcgatggggaaaattatctaccatacgatgttcgacaacatgcaaaaagcgattgacctgaatcgtcctgcctgtcaggacaccggggagattatgttcttcgttaaagtcggttcccgcttcccactgcttggcgagctgcaaagcatactcaaacaagccgtggaagaggcaaccgtcaaagcgccactacgtcacaatgcggtagaaatttttgacgaagtaaacaccggcaaaaataccggtagcggcgtaccgtgggtcacctgggacatcatccccgacaatgacgatgcggaaatcgaagtttacatggcaggcggcggctgcacgctacctggccgctcgaaagtgttaatgccgtcagaaggctacgaaggcgtggtgaaattcgtcttcgaaaatatctccaccctcgccgtaaacgcctgtccaccggtactggtgggcgtgggcatcgccacctcggtggaaaccgccgccgtactctcgcgtaaagccattttgcgcccgattggcagccgccatcccaatccaaaagcggcagaactggagctacgcctggaagaaggactcaaccgtctggggattggtccacaagggctgaccggcaacagttcagtgatgggcgtacatatcgaatctgccgcccgccatccgtcaaccatcggcgttgctgtctctaccggctgctgggcgcatcgtcgcggcacgctgctggttcatgccgatctcacctttgaaaatctgtctcacacccggagcgcgttatgaaaaagatcctgacaaccccgatcaaagctgaagatctgcaagatattcgcgtcggcgatgtgatctacctgaccggtacgctggtgacctgccgcgacgtttgtcaccgccgtttgatcgaactgaaacgtccgatcccttacgatctcaacggcaaagcgattttccacgctggccccatcgtgcgcaaaaacggcgacaaatgggagatggtctccgtcggcccgacaaccagtatgcgtatggaaagttttgaacgtgaatttattgagcagaccggcgtgaaactggtggttggcaaaggtggtatggggccgctgaccgaagaaggctgccagaaattcaaggcgctacatgtgattttcccggcaggctgcgcggtgctggcggcaacccaggtggaagagattgaagaagtgcactggacagagctcggaatgccggagtcactgtgggtctgccgggtcaaagagttcggcccgctgattgtctctattgatacccacggcaacaacctgatagccgaaaacaaaaagctgttcgccgaacgccgcgatcccatcgtggaagagatctgcgagcacgtccattacatcaaataaccctcccggagaggctcacccctctcctttttcgcaggcataacacgatgaaaccttccactgaatggtggcgatatcttgcgccgctggcggtcatcgccattattgctctacttccggttcccgcagggctggagaaccatacctggctctactttgccgtttttactggcgtgatcgttggactgatcctcgaacccgtgccgggtgccgtggtggcgatggtgggtatatccatcatcgccatactctctccctggctgctgttcagcccggagcagctcgctcagccaggctttaaattcactgcaaaatccctctcgtgggccgtttccggtttttctaattcggttatctggctgattttcgccgcctttatgtttggcacaggctatgaaaaaaccgggcttggacgccgcattgcgctgattctggtgaaaaagatgggacatcgcacgctgtttctcggctatgcggtgatgttctccgagctgatcctcgcacctgtaacaccgtccaactcggcgcgtggtgcggggattatctatcccatcatccgtaacctgccaccgctctatcaatcacaaccaaacgacagcagttcgcgcagcattggctcgtacatcatgtggatggggattgttgccgactgcgtgaccagcgccattttcttgacggcgatggcaccaaacttgctgttaattggactgatgaaaagcgcatctcacgccacgctgagttggggcgactggttcctcgggatgttgccgctcagcattttactggttctgctggttccctggctggcttacgtgctgtacccgccggtactgaagtctggcgatcaggtgccgcgctgggcagagacggaactgcaggcaatgggcccgctctgttcgcgtgaaaaacggatgctggggctgatggtaggcgcgctggtgctgtggattttcggcggtgattatatcgatgccgcgatggtcggttacagcgtggtggcactgatgctgcttctgcgcattatcagttgggacgacattgtcagtaataaagcggcgtggaacgttttcttctggctggcctcgcttatcaccctcgccaccggactcaacaacaccggttttattagctggtttggcaaactgttagcaggcagcttaagcggttattcgccaacgatggtgatggtggcgttgattgtggtgttttatctactgcgctactttttcgccagcgccacggcgtatacctccgctctcgcaccgatgatgattgctgctgcgctggcgatgccggaaatcccgctgccggtgttctgcctgatggttggtgcggcaattggtctggggagcattcttacaccatacgccaccggccccagtccgatttactacggcagtggttatctgccaacggcggattactggcgactgggggcgatttttgggctgatattcctcgtattgctggtgattaccggcttactgtggatgcccgtggtgttgctttaagtgaggacggtgccggaaattgctctccggcacccaatagttttacgcagccggtaactccgccagcggccagcgcggacgcacgctaacgccgagatccgccgtcgcgcctgctttaaaccgcaccattccggcataggcgatcatcgcgccgttatcagtacaaaattccggacgcgcgtagaacacttcgccgcggcgttttttcatcatttcagccagcttcgcccgtaacgtacggttagcactcacgccgcccgccatgaccagtcgcttaaagcccgtctgatccagcgcccgcttgcacttaatcatcagcgtatcgaccaccgcatcttcaaaggcgcgggcgatatcagcacgcgtctggtcgtcggtgccgttgtcacgaatggtatttgccgcgaaggttttcaggccggagaagctgaaatccagccccggacggtcggtcatcggacgcgggaagacaaagcgcccggcagtaccctgagccgccattttcgacagtaacggcccgccaggataatccagccccagcagcttcgcggttttatcaaacgcttccccggcggcatcatcgatagactcgccgagcagctcgtactgaccaatgccagtcacgctgattaactgcgtatgaccgccggaaacaagcagcgcaacaaacggaaattccggcgggttatcttccagcatcggcgctaacagatgcccttccatatggtgtacagggatcgccggaacgtcccaggcaaacgccagagaacgccccacggtcgcgccaaccagtagcgcgccgactaatccagggcctgcggtataggccacagcatcaatgtcttttgccgttaaaccagactcctttagcgccgcctggatcaacggtacggttttacgcacatgatcgcgggaggccagttcaggcacgacgccgccgtagtcagcgtgcaatttcacctgactatacaattggttggctaacaaacctttttcatcgtcgtaaatggcgatgccggtttcatcgcaggaagtttcaatacccagtacacgcatgacttgttttacctcgctttattaccgcgcagtgtaggaccaatgcgggttgatgtaaaactttgttcgcccctggagaaagcctcgtgtatactcctcacccttataaaagtccctttcaaaaaaggccgcggtgctttacaaagcagcagcaattgcagtaaaattccgcaccattttgaaataagctggcgttgatgccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgactaccgaacgtaagcgcgctaaagcttctgcagtgaaacgtcacgcgaagaaactggctcgcgaaaacgcacgccgcactcgtctgtactaattccccgagagcgttgctctccgatcagaccgagttgtagttgtaaggccgtgcttccgaaaggaatgcgcggcttattttcgtttatgaattgctaaaaatcggggcctatggctggacgaatcccacgcgtattcattaatgatctgctggcacgcactgacatcgtcgatctgatcgatgcccgtgtgaagctgaaaaagcagggcaagaatttccacgcgtgttgtccattccacaacgagaaaaccccgtccttcaccgttaacggtgagaaacagttttaccactgctttggatgtggcgcgcacggcaacgcgatcgacttcctgatgaactacgacaagctcgagttcgtcgaaacggtcgaagagctggcagcaatgcacaatcttgaagtgccatttgaagcaggcagcggccccagccagatcgagcgccatcagaggcaaacgctttatcagttgatggacggtctgaatacgttttaccaacaatctttacaacaacctgttgccacgtctgcgcgccagtatctggaaaaacgcggattaagccacgaggttatcgctcgctttgcgattggttttgcgccccccggctgggacaacgtcctgaagcggtttggcggcaatccagaaaatcgccagtcattgattgatgcggggatgttggtcactaacgatcagggacgcagttacgatcgtttccgcgagcgggtgatgttccccattcgcgataaacgcggtcgggtgattggttttggcgggcgcgtgctgggcaacgatacccccaaatacctgaactcgccggaaacagacattttccataaaggccgccagctttacggtctttatgaagcgcagcaggataacgctgaacccaatcgtctgcttgtggtcgaaggctatatggacgtggtggcgctggcgcaatacggcattaattacgccgttgcgtcgttaggtacgtcaaccaccgccgatcacatacaactgttgttccgcgcgaccaacaatgtcatttgctgttatgacggcgaccgtgcaggccgcgatgccgcctggcgagcgctggaaacggcgctgccttacatgacagacggccgtcagctacgctttatgtttttgcctgatggcgaagaccctgacacgctagtacgaaaagaaggtaaagaagcgtttgaagcgcggatggagcaggcgatgccactctccgcatttctgtttaacagtctgatgccgcaagttgatctgagtacccctgacgggcgcgcacgtttgagtacgctggcactaccattgatatcgcaagtgccgggcgaaacgctgcgaatatatcttcgtcaggaattaggcaacaaattaggcatacttgatgacagccagcttgaacgattaatgccaaaagcggcagagagcggcgtttctcgccctgttccgcagctaaaacgcacgaccatgcgtatacttatagggttgctggtgcaaaatccagaattagcgacgttggtcccgccgcttgagaatctggatgaaaataagctccctggacttggcttattcagagaactggtcaacacttgtctctcccagccaggtctgaccaccgggcaacttttagagcactatcgtggtacaaataatgctgccacccttgaaaaactgtcgatgtgggacgatatagcagataagaatattgctgagcaaaccttcaccgactcactcaaccatatgtttgattcgctgcttgaactgcgccaggaagagttaatcgctcgtgagcgcacgcatggtttaagcaacgaagaacgcctggagctctggacattaaaccaggagctggcgaaaaagtgatttaacggcttaagtgccgaagagcgatcgggaagcccccgacagccgcactgagaggcagcggcaaatatataagtacgccctcgtaattatcgttggcggtaaacaaccgttggatttcagcgttaacggctgaaggacatcgggtcaatcgcccaacaccaacctcatgaaataagtgtggataccgtcttatggagcaaaacccgcagtcacagctgaaacttcttgtcacccgtggtaaggagcaaggctatctgacctatgccgaggtcaatgaccatctgccggaagatatcgtcgattcagatcagatcgaagacatcatccaaatgatcaacgacatgggcattcaggtgatggaagaagcaccggatgccgatgatctgatgctggctgaaaacaccgcggacgaagatgctgccgaagccgccgcgcaggtgctttccagcgtggaatctgaaatcgggcgcacgactgacccggtacgcatgtacatgcgtgaaatgggcaccgttgaactgttgacccgcgaaggcgaaattgacatcgctaagcgtattgaagacgggatcaaccaggttcaatgctccgttgctgaatatccggaagcgatcacctatctgctggaacagtacgatcgtgttgaagcagaagaagcgcgtctgtccgatctgatcaccggctttgttgacccgaacgcagaagaagatctggcacctaccgccactcacgtcggttctgagctttcccaggaagatctggacgatgacgaagatgaagacgaagaagatggcgatgacgacagcgccgatgatgacaacagcatcgacccggaactggctcgcgaaaaatttgcggaactacgcgctcagtacgttgtaacgcgtgacaccatcaaagcgaaaggtcgcagtcacgctaccgctcaggaagagatcctgaaactgtctgaagtattcaaacagttccgcctggtgccgaagcagtttgactacctggtcaacagcatgcgcgtcatgatggaccgcgttcgtacgcaagaacgtctgatcatgaagctctgcgttgagcagtgcaaaatgccgaagaaaaacttcattaccctgtttaccggcaacgaaaccagcgatacctggttcaacgcggcaattgcgatgaacaagccgtggtcggaaaaactgcacgatgtctctgaagaagtgcatcgcgccctgcaaaaactgcagcagattgaagaagaaaccggcctgaccatcgagcaggttaaagatatcaaccgtcgtatgtccatcggtgaagcgaaagcccgccgtgcgaagaaagagatggttgaagcgaacttacgtctggttatttctatcgctaagaaatacaccaaccgtggcttgcagttccttgacctgattcaggaaggcaacatcggtctgatgaaagcggttgataaattcgaataccgccgtggttacaagttctccacctacgcaacctggtggatccgtcaggcgatcacccgctctatcgcggatcaggcgcgcaccatccgtattccggtgcatatgattgagaccatcaacaagctcaaccgtatttctcgccagatgctgcaagagatgggccgtgaaccgacgccggaagaactggctgaacgtatgctgatgccggaagacaagatccgcaaagtgctgaagatcgccaaagagccaatctccatggaaacgccgatcggtgatgatgaagattcgcatctgggggatttcatcgaggataccaccctcgagctgccgctggattctgcgaccaccgaaagcctgcgtgcggcaacgcacgacgtgctggctggcctgaccgcgcgtgaagcaaaagttctgcgtatgcgtttcggtatcgatatgaacaccgactacacgctggaagaagtgggtaaacagttcgacgttacccgcgaacgtatccgtcagatcgaagcgaaggcgctgcgcaaactgcgtcacccgagccgttctgaagtgctgcgtagcttcctggacgattaatcggtaggccggatcaggcgttacgccgcacccggcactaggccctctgcacaaacgccaccttttcggtggcgttttttatcgcccacgcactaccagcgcctggtccagctcgcgatacgcttcaaccagtttctccagtgaaacgcgacttaaaccgctgggatttggcagcacccaaatctgcgtcgaaccaatggtgagcgtttgtttcccccactgtgcaccgcgctggctgaatccctgttcatatgcttgtttgcccagaatcgccaacgcctgcggctgataatcttcaattttttcaatcagcttacgcccgcctgcgtgtagctcctgctttgaaacttcattggcttgcaccgttggacggtctaccagtttggtgacgccacaacgataatccagcagatgctgtgcctcctgcggcttcaactgacggtcggtaaacccggcctgatatatcaccttccagaagcgatttgccggatgagcaaagggaaaaccagtcccggcggatgaaagcccagggttgataccgcaaaacacgacccgtaaccctggagccaaaatatcctcaaccatatttactcctttctaacatcaccaggaaaagtataacggattgaaaatacattgtttataaaaacagcaggcgcgcggtaatggctggattgcgacacggagttactttataatccgctaccatggccccttagctcagtggttagagcaggcgactcataatcgcttggtcgctggttcaagtccagcaggggccaccagatatagcaaaggctgacgagaaatcgtcagcctttttctttttatatatcagttactttgcgtgccagtaagccgctgcacgtacccgctgtgggtcatactgttccgcttcaaagcggcggcttaaattcttaacgactttaccttcgccggttatccagatgaagtaatcatcggcagggatttgcatctgcgccagacgcgcatctaccgcctgctcatcatgtgccagccattcgatattaaaaccatcaaggtgcgcgagataatcctgacaggcgttatcccgcacgctaaccagcgcactaacttgcggtttaacggcaagtttgctcaacgtttccaggcggcggcgcaatgcaggcattccggattcatcgcagacatacagctgatacgcgtaatcttccggcaccaccagcgaaccgcgcggacctgccaccgtaagtttatcgcccggttgcgcctgcatcgcccagccgctggcgaccccaccgtcgtgaataaagaaatcaatcgccagttcatggcgtagttcgtcatacagcggcgtatagtcacgcgacggtgggcgtggtccttccggccagacgatgccctcttccgttaccgttggcggcacaaagtgagcgtcaggttgaggaaagaagagtttgctgtgatcgtcaaagccacgcgatgtaaaaccgtccagcgcctcgccgccgaggacaatgcgctgaaaaccggcgctgatgcgctcaacgcgtaacacagtcagttcacggaagcgcagatcattgcgaacgcgctgcgggtagcggggggtgttattcattgttatcgccttcgtgatggtaatcagatatatctaaataaaactcgcaaatgataatgattgttaatcatgataaatgcaagcgatttgtagaactgatatgtctatagtctgataagacgaaccgcctcttctcaggcatcattactcaacgccggatgcggcgtgaacgccttatccggcctacgtgtgagatgagtccacgtttaaaaatcatttttacacttgcaagaacgctcatatcagatataaattagatatatctaattaagcaaaaggaggctgatatgagccatcatcacgaagggtgttgtaaacatgaaggccagccacgccatgagggctgctgcaaaggtgagaagtcagaacacgagcactgcggacacggtcaccagcatgaacacggtcaatgctgcggtggtcgccacggtcgcggcggcggtcgtcggcaacgtttctttggtcacggtgaattacgtctggtgattctggatattctctcgcgcgatgacagccacggttacgaattgattaaagcgattgagaatctaacccaggggaattacaccccaagcccgggcgtcatctacccaacgctggattttctgcaggagcagtcgctgattaccatccgcgaagaggaaggaggtaagaagcagattgcgctgaccgaacaaggcgcgcagtggctggaagaaaaccgcgaacaggtggagatgattgaagaacgcatcaaagcgcgttgcgttggcgcggcgctgcgccagaacccgcaaatgaagcgggcgctggataattttaaagcggtgctggatttacgcgtcaaccagagcgatatcagtgatgcacaaataaaaaagatcattgcggtgatcgaccgcgccgcttttgatattacgcaactggattaatcgccgcatccgccagtggcgcggtgcaattgccggatgcgacgcttgacgcgccttatccggcctacacccgctacacaccccgcaggcctgataagatgcgccagcatcgcatcaggcattgtgctccaaccgccggatccggcataccgattaatgcagtaccgtcaccgcgtcttccagtcggctggcgcggtgtttcaccatcgccgacacctgcgcactctcttccaccagctcggcatttttctgggtgatcaggttaagctcatccactgcacgggtcaggctggaaagcccatcggcctgttccagcgttgaatggctaatctgggcgatcaactgggtgacgtttttcacctgtgccacaatatcttccatcgtccgtccggcggcgtgtacctgctgcgaaccggattgcaccttatcagcactggcatcaatcagcttgcgaatatcgttggcagcattagcgctgcggctggctaaatgacgcacttcccctgccaccactgcaaaacctttgccctgttcgccggcacgcgccgcttccaccgccgcattcagggccagaatattggtctgaaacgcaatatcgttaatcagcgaagtaatggtgccaatgcgctgggtactgtcggcgatatcgtccattgtcttgatcaccgtggtcatcgcctccccaccctgcactgccgcattactggcagtgattgacagtttatcggcagccgacgccgtggcagagttctgtttcaccgacgccgccatttggttcatggtcgccaccgtttgctgaacgttatcaactgtctgctgggtatgttcgttcagttcatcggtgcctttcgccagcgtctcactgccatttctgacactggacacctggcttgagacatcgttaattagccaacggcacatcaggccaagttgccctaccgcacgtaatgtcagccccagctcatcgctgcgattcagatgctcaacactattacgttctccggtcgccaccttcagtgcctgatgggcaacattttctatcgggcgcacaatctgccattcaaaacaggcgcttgccaacaataccactaacgcacagaggatatacgtcaccaccggggcagcaacaaaccaaagcatggccgccagcaagataaacatcagggtcatcactccacgcgcccgccagcgaagcggtaatgaaggcagtttacccagccagcctttacgcaccaccaggcctttatgaatacgcttactggtacgtccggcgttcaacgctttgtacagcggctccaccgccgcgatctcttcatccgtcgcccgggtacgaatcgacatatagccactgatttttccctcgcgcaccatcggtaccgcattggcccgcacccaataatggtcaccatttttgcggcgatttttcacgatgccgctccagggctccccttttttcagggtgaaccacatatccgcaaacgccgcttttggcatatccgggtgacgcaccatgttgtgcggctgcccttgtaactcttgcaaggtatagccgctcacctgcacaaaagtgtcattagcatgagtgatatagctttgcagatcggtagtggacatcagagtggtatcgtccgccagcggggtattttgctgggtgacatacggatgagaagacatgttcgcgtcctgtgcaggttatatggttgttaacttcttgtcagagtttatgtcggccccgctgcggttatctttaaccgattaatttgatttagatcgcaatttgcgatttaaacacaaatctaattccttgatttaaaatactttcactctgttactatacgaaaacgttaattatcttgcccaaaaatcaggcaattattgccctgaaaacgtgcatttgcgcagcaatcatcaaatccatacccgacaaaaaccgtgcaaaataacaacaaatgttaacagatagcattaaatattgcacaaatgataaccgaatttgtgtttatcccgattttcgcgatcgcagccggagtggcgcaatccctgcaatacttaaatcggtatcatgtgatacgcgagcctccggagcatattttgaacaggttaccttcgagcgcatcggctttagcgtgcagcgcccacgccctgaatctcattgagaagcgaacgctggatcatgaggagatgaaagcacttaaccgagaggtgattgaatacttcaaagagcatgtcaatccggggtttttagagtatcgcaaatctgttaccgccggcggggattacggagccgtagagtggcaagcgggaagtttaaatacgcttgtcgacacccagggccaggagtttatcgactgcctgggaggttttggaattttcaacgtggggcaccgtaatccagttgtggtttccgccgtacagaatcaacttgcgaaacaaccgctgcacagccaggagctgctcgatccgttacgggcgatgttggcgaaaacccttgctgcgctaacgcccggtaaactgaaatacagcttcttctgtaatagcggcaccgagtccgttgaagcagcgctgaagctggcgaaagcttaccagtcaccgcgcggcaagtttacttttattgccaccagcggcgcgttccacggtaaatcacttggcgcgctgtcggccacggcgaaatcgaccttccgcaaaccgtttatgccgttactgccgggcttccgtcatgtgccgtttggcaatatcgaagccatgcgcacggctcttaacgagtgcaaaaaaaccggtgatgatgtggctgcggtgatcctcgaaccgattcagggtgaaggtggcgtaattctgccgccgccgggctatctcaccgccgtacgtaagctatgcgatgagttcggcgcactgatgatcctcgatgaagtacaaacgggcatggggcgcacgggcaagatgttcgcctgcgagcatgagaacgtacagccggatatcctctgccttgccaaagcgctcggcggcggcgtgatgccgattggcgcgaccatcgccactgaagaggtgttttcagttctgttcgacaacccattcctgcataccaccacctttggcggcaacccgctggcctgtgcggcggcgctggcgaccatcaatgtgttgctggagcagaacttaccggctcaggctgagcaaaaaggcgatatgttgctggacggtttccgtcaactggcgcgggaatatcccgatctggtacaggaagcgcgtggtaaagggatgttgatggcgattgagtttgttgataacgaaatcggctataactttgccagcgagatgttccgccagcgcgtactggtggccggaacgctcaataacgccaaaacgatccgcattgaaccgccactgacactgaccattgaacagtgtgaactggtgatcaaagcggcgcgtaaggcgctggcggccatgcgagtaagtgtcgaagaagcgtaatatcaaatcggatggcgatacgacgtcgccatccgatctttttatacgacgcgtacgcccgcaggcatcatccgctccggcgttaacagcacgctttcactgccgtcatcggtttccgcacacaacagcatgcattccgacgtttcaccacgcattttcgctttttgcagattgcataagaccaccaccgttttccccatcagctcttcttcgctgtagtacggcaccaggctggtcacggtttgcagcgttttttgccccacatcaacctgtacgatgtacagcttgtcggcgttttcatggcgtttcacttccacaatctttccgacgcgcatttccagacgtgcaaaatcagcgtaagccacggtttccattgcttcctcccttagggtaaaattttactaaactatagcaaaagtttttctcaatcctgtaggctaaaaatggagaatgcaggcgtgatcacattcgtgagccgctgtgttaccgttacagcgtcaaagaaacgcgctttatttactgaaaacaggtgacccgataagcacttcctctacaatgggggcgcacatcagggaaagtaaaaaaggtaaacatggcaacactaaaagacatcgcaatcgaagctggcgtatccctggcgacagtatccagggtcttaaatgacgatccgacattgaatgtgaaagaagagacgaaacatcgcattctcgagatcgccgaaaagctggagtacaagaccagtagtgcccgtaaactccagacaggtgcagtcaaccaacaccatattctggctatctacagctaccagcaggagctggagatcaacgatccttactatctggcgatccgccacggcattgaaacccagtgcgaaaagctgggcatcgagctcaccaactgttatgaacacagcggcttaccagacattaaaaacgtcaccggtattttaattgtcggcaaacccacgcccgccctgcgcgccgctgccagcgcgttgaccgacaatatctgttttatcgactttcacgaacccggcagcggttacgatgcggtggatatcgatctggcacgcatcagtaaagaaatcatcgacttctatatcaaccagggcgttaatcgtattggttttattggcggtgaagatgagcctggcaaggcggatattcgtgaggtcgcctttgcggaatatggccgactgaaacaagtggtacgcgaagaggatatctggcgcggcggtttttccagttcgtcgggttatgaactggcaaaacaaatgctggcgcgggaagactatccgaaggcactgtttgttgcttccgattccattgctatcggcgtactgcgggcaattcatgaacgaggcctgaacatcccacaggatatttcgcttatcagcgttaacgatatccccaccgcgcgatttacctttccgccgctctccaccgtgcgcatccattccgagatgatgggaagtcagggcgttaacctggtgtatgaaaaagcccgcgatggtcgcgcgctgccgctgttagtcttcgttcccagcaaattaaaactgcgcggcacgacccgttaaatccccttacacactgtccggcaatcgtttttgccggacagtgctgccgtttattttcgtgatccagttaaagtaaatgcatttacctgctactttttagtaaaaattttactaaactccccagcaattacacaaactaccatcaccatgaatggttccgatttctctctaccgggaggccctatgaatcgctgggaaaacattcagctcacccacgaaaaccgacttgcgccgcgtgcgtactttttttcatatgattctgttgcgcaagcgcgtacctttgcccgcgaaaccagcagcctgtttctgcccttaagcggtcagtggaatttccacttttttgaccatccgctgcaagtaccagaagccttcacctctgagttaatggctgactgggggcatattaccgtccccgccatgtggcaaatggaaggtcacggcaaactgcaatataccgacgaaggttttccgttccccatcgatgtgccgtttgtccccagcgataacccaaccggtgcctatcaacgtattttcaccctcagcgacggctggcagggtaaacagacgctgattaaatttgacggcgtcgaaacctattttgaagtctatgttaacggtcagtatgtgggtttcagcaagggcagtcgcctgaccgcagagtttgacatcagcgcgatggttaaaaccggcgacaacctgttgtgtgtgcgcgtgatgcagtgggcggactctacctacgtggaagaccaggatatgtggtggtcagcggggatcttccgcgatgtttatctggtcggaaaacacctaacgcatattaacgatttcactgtgcgtaccgactttgacgaagcctattgcgatgccacgctttcctgcgaagtggtgctggaaaatctcgccgcctcccctgtcgtcacgacgctggaatataccctgtttgatggcgaacgcgtggtgcacagcagcgccattgatcatttggcaattgaaaaactgaccagcgccagctttgcttttactgtcgaacagccgcagcaatggtcagcagaatccccttatctttaccatctggtcatgacgctgaaagacgccaacggcaacgttctggaagtggtgccacaacgcgttggcttccgtgatatcaaagtgcgcgacggtctgttctggatcaataaccgttatgtgatgctgcacggcgtcaaccgtcacgacaacgatcatcgcaaaggccgcgccgttggaatggatcgcgtcgagaaagatctccagttgatgaagcagcacaatatcaactccgtgcgtaccgctcactacccgaacgatccgcgtttttacgaactgtgtgatatctacggcctgtttgtgatggcggaaaccgacgtcgaatcgcacggctttgctaatgtcggcgatattagccgtattaccgacgatccgcagtgggaaaaagtctacgtcgagcgcattgttcgccatatccacgcgcagaaaaaccatccgtcgatcatcatctggtcgctgggcaatgaatccggctatggctgtaacatccgcgcgatgtaccatgcggcgaaagcgctggatgacacgcgactggtgcattacgaagaagatcgcgatgctgaagtggtcgatattatttccaccatgtacacccgcgtgccgctgatgaatgagtttggtgaatacccgcatccgaagccgcgcatcatctgtgaatatgctcatgcgatggggaacggaccgggcgggctgacggagtaccagaacgtcttctataagcacgattgcattcagggtcattatgtctgggagtggtgcgaccacgggatccaggcacaggacgaccacggcaatgtctggtataaattcggcggcgactacggcgactatcccaacaactataacttctgtcttgatggtttgatctattccgatcagacgccgggaccgggcctgaaagagtacaaacaggttatcgcgccggtaaaaatccacgcgcgggatctgactcgcggcgagttgaaagtcgaaaataaactgtggtttaccacgcttgatgactacaccctgcacgcagaggtgcgcgccgaaggtgaaacgctcgcgacgcagcagattaaactgcgcgacgttgcgccgaacagcgaagcccccttgcagatcacgctgccgcagctggacgcccgcgaagcgttcctcaacattacggtgaccaaagattcccgcacccgctacagcgaagccggacaccctatcgccacttatcagttcccgctgaaggaaaacaccgcgcagccagtgcctttcgcaccaaataatgcgcgtccgctgacgctggaagacgatcgtttgagctgcaccgttcgcggctacaacttcgcgatcaccttctcaaaaatgagtggcaaaccgacatcctggcaggtgaatggcgaatcgctgctgactcgcgagccaaagatcaacttcttcaagccgatgatcgacaaccacaagcaggagtacgaagggctgtggcaaccgaatcatttgcagatcatgcaggaacatctgcgcgactttgccgtagaacagagcgatggtgaagtgctgatcatcagccgcacagttattgccccgccggtgtttgacttcgggatgcgctgcacctacatctggcgcatcgctgccgatggccaggttaacgtggcgctttccggcgagcgttacggcgactatccgcacatcattccgtgcatcggtttcaccatgggaattaacggcgaatacgatcaggtggcgtattacggtcgtggaccgggcgaaaactacgccgacagccagcaggctaacatcatcgatatctggcgcagcaccgtcgatgccatgttcgagaactatcccttcccgcagaacaacggtaaccgtcagcatgtccgctggacggcactgactaaccgccacggtaacggtctgctggtggttccgcagcgcccaattaacttcagcgcctggcactatacccaggaaaacatccacgctgcccagcactgtaacgagctgcagcgcagtgatgacatcaccctgaacctcgatcaccagctgcttggcctcggctccaactcctggggcagcgaggtgctggactcctggcgcgtctggttccgtgacttcagctacggctttacgttgctgccggtttctggcggagaagctaccgcgcaaagcctggcgtcgtatgagttcggcgcagggttcttttccacgaatttgcacagcgagaataagcaatgaggatcatcgataacttagaacagttccgccagatttacgcctctggcaagaagtggcaacgctgcgttgaagcgattgaaaatatcgacaacattcagcctggcgtcgcccactccatcggtgactcattgacttaccgcgtggagacagactccgcgaccgatgcgctatttaccgggcatcgacgctattttgaagtgcattactacctgcaagggcagcaaaaaattgaatatgcgccgaaagagacattacaggtagtggaatattatcgtgatgaaactgaccgtgaatatttaaaaggctgcggagaaaccgttgaggtccacgaagggcaaatcgttatttgcgatatccatgaagcgtatcggtttatctgcaataacgcggtcaaaaaagtggttctcaaagtcaccatcgaagatggttatttccataacaaataacaactacggcggcaaaaggagtttgccgccaccgctaccctactcattttcggagatgtgttatgtctgataccaaacgtaatacaatcggcaaattcggcttgctctcgctgacttttgccgccgtttacagctttaacaacgttatcaataataatattgagcttggactggcctcggcaccgatgtttttcctcgcgacgattttttattttattcccttctgtctgatcatcgcagaatttgtttcgttaaataaaaactcagaagccggtgtctacgcgtgggtaaaaagttcgctgggcggacgttgggcatttattactgcctatacctactggttcgtaaacctgttctttttcacctcactgttgccgcgcgttattgcttatgcttcgtatgccttcctcggatacgaatatattatgacgccggttgccaccaccattatcagtatggtgctgttcgccttctccacctgggtttccaccaacggggcgaaaatgttggggccaattacctccgtcacttcaacgctgatgctgctgttaacgctctcctacattttactggcaggtacggcgctggttggcggcgtacagcctgctgacgccatcaccgttgacgcgatgatcccgaacttcaactgggcgttcctcggcgttaccacctggatctttatggccgcaggtggcgcggagtccgtcgctgtgtacgttaacgacgtcaaaggcggttcgaaatcgttcgttaaagtgatcatcctcgccgggatttttatcggcgtactgtattccgtctcctcggtgctgattaacgtcttcgtcagcagcaaagagttgaaatttaccggcggatcggtgcaggtattccacggcatggcggcgtattttggtctaccggaagcgttgatgaatcgctttgtcggtctggtgtcctttaccgcgatgttcggttccctgctgatgtggaccgcaacgccggtgaaaattttcttctccgaaatcccggaaggcatctttggtaagaaaaccgtcgaactgaacgaaaacggcgttccggcgcgcgcagcgtggatccagttcctgatcgtcatcccgctgatgattatcccgatgctcggttccaataccgtgcaggatctgatgaatactattattaatatgaccgccgcagcgtccatgcttccgccgttattcatcatgctggcttacctgaatttacgcgccaaattagatcacctgccacgcgatttccgtatgggctcccgccgcaccggtattatcgttgtttcaatgctgattgcgatatttgccgtagggtttgtcgcttcgacattcccgactggcgcgaatattctgaccatcattttttataacgtcggcggtattgttatcttccttggctttgcgtggtggaaatacagtaaatatataaagggattaacggctgaagagcgccatattgaagcgacgccagccagcaatgttgattaagcagaataataaaaaatgagcaggcattttccctcttcctggatgaggagagggaaaatagtttctgcctttatatttttataattacaacgataaaaggctgtactttttctttagctcatggattaacacaatgaaattaatcactgcaccatgcagagcattacttgctctgccgttttgctacgccttttctgcggcaggagaagaagcacgtccggcagaacatgacgacacaaaaacacccgcaattacctcgacatcttctccttcatttcgtttttacggcgaattaggggttggtggatatatggatttagagggtgagaataaacataaatacagcgacggtacctatattgaaggtggcctggagatgaagtacggctcctggttcggcctgatttacggcgaaggctggaccgtgcaggccgaccacgacggcaatgcctgggtgccagaccatagctggggtggtttcgagggcggaattaaccgtttctatggcggttatcgtaccaatgatggcaccgaaatcatgctcagtctgcgtcaggattcctcgctggatgacctgcaatggtggggcgatttcacccccgatctgggctacgtcattcccaatacccgcgacattatgactgcgctgaaggtacagaacttaagcggcaactttcgttatagcgtcaccgcgactcctgccggacatcatgatgaaagcaaagcctggctacattttggcaaatacgatcgctatgacgacaaatacacctatccggcaatgatgaacggttacatccagtatgaccttgccgaaggcatcacctggatgaacggtctggaaatcaccgacggcacaggacagctctatctcacgggcctgctaactcctaactttgccgctcgcgcctggcaccataccggacgcgccgacgggctggacgtaccgggaagtgaaagtgggatgatggtgagcgccatgtatgaagcgttaaagggcgtttatctctccaccgcttacacctacgccaaacatcgccctgaccacgctgacgatgaaaccacctctttcatgcagtttggtatctggtacgaatacggcggcggacgtttcgccacggcttttgatagccgcttctacatgaaaaatgcctctcacgatcccagcgaccaaatcttcctgatgcaatatttctactggtaataaggactgtaatttcatgaaaataaaaactattttaacgccagtaacctgcgctctgctgataagtttttccgcccatgccgctaacgccgacaattataaaaacgtgattaaccgtactggcgcgccgcagtacatgaaggattacgattacgacgatcaccagcgttttaatccgtttttcgatctcggagcctggcatggtcatctgttgccagacggccctaacaccatgggcggctttccgggcgttgcgctgctgacggaagagtacatcaactttatggccagcaatttcgaccgcctgaccgtctggcaggacggcaagaaagtcgactttacgctggaggcatacagtattcccggtgcgctggtgcaaaaactgacagcaaaagatgtgcaagtcgaaatgactctgcgcttcgccacgccgcgcacgtcactactggaaaccaaaatcaccagcaataaaccgctggatctggtgtgggacggcgaactgctggaaaaactggaagcgaaagaagggaaaccgctttccgataaaaccattgctggcgaataccctgactatcagcgcaaaatcagcgccacccgtgatggcctgaaagtcacctttggcaaagtgcgcgccacctgggatctgctgacctccggcgaatcggaatatcaggtgcataaatccctgccggtgcagactgaaatcaacggtaatcgctttaccagtaaggcgcatatcaacggttcgaccacgctctacaccacctattcccatctgctgaccgctcaggaagttagcaaagagcaaatgcagatccgcgatattctggcgcgtccggcgttttatctcaccgcctcgcagcaacgctgggaagaatacctgaagaaagggttaaccaatccggatgcgacgccggaacagacgcgcgtcgcggtgaaagcgatcgaaacgctcaacggtaactggcgctcaccgggcggtgcggtgaaatttaacaccgttacaccgtcggtgaccgggcgctggttctccggcaatcagacctggccgtgggatacctggaagcaggcgtttgcgatggcgcatttcaatccggacatcgccaaagagaatatccgcgcggtcttctcctggcagatccagcctggcgatagcgtgcgtccgcaggatgtgggctttgtccccgacctgatagcgtggaaccttagccccgagcgtggtggcgatggcggcaactggaacgaacgtaataccaaacccagccttgccgcctggtcggtgatggaagtgtataacgtcacccaagataaaacctgggtggcagagatgtacccgaaactggtggcctatcacgactggtggttacgtaaccgcgatcacaacggcaacggcgtgccggaatatggcgcgacccgcgacaaagcccacaacactgagagcggcgagatgctgtttacggtgaaaaaaggcgataaagaagagacgcagtctgggctgaacaactacgcccgcgtggtggagaaaggccagtacgacagtctggaaattccggcacaggttgctgcatcgtgggaatcggggcgtgatgatgccgccgtctttgggtttatcgacaaagaacagttggataaatatgtcgctaatggcggcaaacgtagcgactggacggtgaaattcgccgaaaaccgcagtcaggacggaacgttgctgggctactcgctattgcaggagtcggtggatcaggccagctatatgtacagcgataaccattatctggcggagatggcaaccatcctcggtaagccagaagaggccaaacgctatcgccagttggcacagcagctcgcggactacatcaacacctgtatgttcgacccgactacccagttctactatgacgtacgtattgaagataaaccactggcgaacggctgcgcgggcaaaccgattgttgagcgcggtaaagggccggaaggctggtcgccgctgtttaacggtgcggcaacgcaggccaatgccgacgcggtggtgaaggtgatgctcgatcctaaagagttcaacacctttgtcccgctgggaacggcggcgttaaccaatccggcttttggcgctgatatctactggcgtgggcgcgtatgggtggatcagttctggtttggtctgaaagggatggagcgttacggttatcgtgatgatgccctgaagctggcggatacgttcttccggcacgccaaagggttaaccgccgatggaccaattcaggaaaattacaacccgctgacaggcgcacagcaaggcgcaccaaatttctcctggagtgccgcgcatttgtatatgttgtataacgattttttccgtaagcaataatttgcaactgctggcggatgcggcgtaaacgccttatccgccctacatgtgcaatcctcctggccggataaaacgcggcaagcgttgcatccggcaactgcaccgcgccactggcggatgcggcgtgaacgccttatccgccctacatgtgtgttcccgtaggtcggataagacgcgacaagcgtcgcatccggcatctgcaccgcgccactggcggatgcggcgtggacgccttatccgccctacatgtgcaattccgtaacctggataaaacgcgacaagcgtcgcatccggcgttatcaccgggcgtattctttttgaatcccatcacaaaccccgcactccccttttcccttttctccggcgacggctaaattagaactcatccgaccacataacaattattttacatactggacaattttatgagctacccgtcgctgttcgccccgctggatttaggttttaccacgttaaaaaaccgcgtgttgatgggctcaatgcacaccgggctggaggaatacccggacggtgccgagcggctggcagcgttttatgccgaacgcgcccgtcacggcgtggcgctgattgtcagcggcggcattgcaccagatttaacaggcgttggcatggaaggtggcgcaatgctcaacgacgccagccagatcccacaccatcgcaccattaccgaagcggtacatcaggaaggcggcaaaatagccctgcaaattttgcataccgggcgctacagctaccaaccgcatctggtcgccccgtccgcattgcaggcccccatcaaccgtttcgtgccccatgagttaagccatgaagagatcctgcaactgatcgacaatttcgcccgctgcgcgcaactggcgcgggaggcaggatacgacggtgtagaggtgatgggttccgaagggtatttgatcaacgaatttctgacgctgcgcaccaatcagcgtagtgaccagtggggcggcgattaccgcaaccggatgcgatttgccgtagaagtagtgcgtgcggtgcgcgaacgcgtcggcaacgacttcattattatctaccgactgtcgatgctcgacctggtcgaagacggcgggacttttgccgaaacggtagagctggcgcaggccattgaagcggcgggcgcgaccattatcaacaccggcattggctggcatgaagcacgtattccgaccattgccacgcccgtgccgcgcggcgcatttagctgggtcacgcgcaaactgaaaggccacgtctcgctgccgctggtaaccaccaaccggattaacgatccgcaggttgccgacgatattctctcgcgcggcgatgccgatatggtatcgatggcgcgaccgtttcttgctgatgcggagctgctgtcaaaagcgcaatcgggacgagccgatgagatcaacacttgtattggctgcaatcaggcctgtctcgatcaaatcttcgttggcaaagtcacctcgtgcctggtgaatcctcgcgcctgccacgaaaccaaaatgccaatccttcccgccgtgcagaaaaaaaatctggcggtggtcggtgcgggacctgctgggctggcgtttgccattaacgcggcggcgcgtgggcatcaggtaacattgtttgacgctcatagcgagattggcgggcagtttaatatcgccaaacagatccccggcaaagaggagttttacgaaacgctgcgctattaccgccggatgatcgaagtgacgggcgtgacgctaaaactcaatcacaccgtgacggcggatcagttacaggctttcgatgaaacgatcctcgccagtgggatcgtgccgcgcactccgcccatcgacgggatcgatcatccgaaggtattgagttatctcgatgtactgcgcgacaaagcgccggttggcaacaaagttgccatcatcggttgtggcgggattggttttgatacggcgatgtatttaagtcagccgggcgaatccaccagccagaatatcgccgggttctgtaatgaatgggggatcgacagtagcctacaacaggctggtggcttaagcccgcagggaatgcagatcccccgtagcccacggcagattgtgatgctccagcgcaaagccagcaaaccaggacaggggttaggcaaaaccaccggctggatccatcgcaccaccctgctctcgcggggtgtgaaaatgatcccaggcgtaagttatcagaagattgacgatgacgggctgcatgtggtgatcaacggcgaaacgcaggtattagcagtggacaatgtggtgatctgcgcagggcaagagccaaaccgcgcgctggcgcaaccgctgattgatagcgggaaaacggtgcatttaattggcggctgcgatgtggctatggagctggacgcacgacgggcaattgcccagggaacacggctggcgctggagatttaaatcgttatttgaagcgccggatgcaacgcatccggcacgtcgcgttaatcaataaacaaggcgggagaaatgccgaatcgcgttgccaattttttagcgtgttccagcgttaatttcctcttcccgctcaaaacgcgtgacaccatagatttactgccaatttccggcagatcggaaagggttaaaccatattgatccataagggtacgaatcacggctataccgccaggcatggcttgagccatggcattaaattccgcaaattcgggcgctgattcttcccacgcggttattttggcacacaccagatccagcaaggggttttcaggatcgttgagcagcagatgatctaccagttccagcgcctgggtgtattgttcctcgttctgaatacccgccagaaaaggtgccacagcagttagcttttctcctgcttgcaagatgtcggcaatcgcaatcattttttccccttagtacgatgaacagcggtaaagaaatcgtattctttatgcgtcataacttcacgtatgtagcacttttgcgattcaaaaaagaccattgctacaacacgtaattcattgcccccaacattgaaaacataatgcttatccagatatttgaagttatccagagatgggaatactgcttttaatgactcaggttttttgaaatatcccttagcaatcgtgttccccagagccaccaactccgttttatgttgcgggtatttttccgcagcatctttcaatgctttttgagttatcaggtgcattcttcatcacgtccgttgacaaattggcaatatgataacatccgttgccagattggcaacggatgaatttatctgtgtgacggaagaataaacgtagaaaaacgctaaacaagagaatgtagacgatggtgacagggattttttgttttatggaagcgcgattccagaactgggcagacattgccggatgcgacgcttgccgcgtcttatccggcctggagtaacgtgctgaacgtaggccggataaggcgtttacgccgcatccggcaggtaactcccaatcttaccgacgacgtcccagcttcaccgctttcagtaccacaaatttattattcgtcgcaatagtggtgcagttgccgaaaatcttcttcagtttatggaagtaatccaggtgacggttggcaacgatatacagctcgccgttgattttcaggcagcggcgggcgtggtggaacatctcccaggcgacgttatcggtcagcgcatgttgttggtgaaacggcgggttgcagagcacagcattaaagcggaaaggctccacgccggagagcgcgttgttgatcataaactcgcagcgatccaacgcctctggcatgttggtttcaacgttcaaacggctggaagcaaccgccatcggcgattcatcgacaaacaccactttcgcctgcgggtttttatcaagcagcgtcagaccaataacgccattaccgcaaccgagatcgacaatctccccttcgagattctctggcagatgttgcataaagaagcgcgcgccgatatcaagcccggtgcgggagaagacattcgcatggttgtggatagtccagtcagtaccttccagcttccagctaacggtctgcggcgcatcggccagctgcggttcattgaaagtgcaattaatcaggcgcgcttttttccatgccagcgtggtggtggttgggccgagcactttttcgaacagttccagcgtggaagtgtgaatgtcacgggccttggcaccggcaataatacgtgtatccgacgtgaccactttgcgcagcgcacgcagttgctgttccagcaatgccagtgttttcggcactttgatcagcaccacacccggctgttgcgggtagtcggcggtgctgtcgagaaacttcacgctcgactcatcaatcccgttgaggcgtaaattctcgcgcgtcgccagttcactgatgtatgagtcgccaatgctgtacggcttatgttccgccagtgcgcagcttaacgcaccaaaggcatcattcaggatcaacaccgggccgcggatttctgtgtcgtccaactgttgcagcaaatattcatccgccgcttcccacgcctgtagcgggttaacgtcatccgtcgccggaaaacgttgtagtgtcagtgaacggaaaccgttgtctaagtggctcatcggccctcctgaatgataaaatttcgacattgcccctgaaaagggtgcgtgagtataccctttttctctttttcgtgggcggttatgagcaatcttacttatcttcagggttatcccgagcagctactttcccaggtgcgaacactgattaacgaacagcgtctgggcgatgtgctggcaaaacgctatccgggaacacacgactacgccaccgataaagccctctggcaatatactcaggatctgaaaaatcagtttctgcgtaatgccccgccgatcaataaagtgatgtatgacaataagatccatgtgctaaaaaacgcgctcgggttacataccgctgtttctcgtgtgcagggcggcaagctgaaagcaaaggtggagatccgcgtcgctaccgtgtttcgcaacgcgccggaaccgtttttgcgcatgatcgtggtgcacgagctggcgcacctgaaggagaaagagcataacaaagcgttttaccagttgtgttgtcatatggaaccccagtaccaccagcttgagttcgacacccgactgtggctaacgcagttgtcgcttgggcagaacaaaatctgaaaatgatgtcaggcgttatcttttctttctttagcgcctaaaatcgacctcccccctttcgttaaggataacgaccatgctgcgcgcatttgcccgccttcttctccgtatttgtttttctcgccggactctaaagattgcctgcttactgttacttgtggcaggagcgaccatccttatcgccgatcgcgtaatggtcaacgccagcaaacagctgacctggagcgatgtcaacgccgttccggcgcgtaacgtgggtttattgctgggggcgaggccgggtaatcgctactttacccgacgtattgataccgcagcagcgttgtaccacgccggaaaagtgaaatggctgctggtaagtggcgataacggacgtaaaaattacgatgaagcatcaggtatgcagcaggctttgatcgctaaaggcgtaccagcaaaagtgatcttctgcgactatgccggattctcaacgctggattcggtagtgcgtgccaaaaaggtttttggtgaaaaccatatcaccattatctcgcaagaatttcataatcaacgcgccatctggctggcaaaacagtacggcatcgacgctatcggttttaacgcgccagacctcaatatgaagcacggtttttatactcaactgcgggagaaactcgctcgtgtcagcgccgtgattgacgccaaaatcctccatcgccagccgaaatatctcgggccttcggtcatgattgggccgtttagtgagcatggctgtccggcgcagaaataatgcgtatctgcgcacgtcgaagatgaaaaaggcgtgctacattgacgacagaatccctttatggagtatccacgcgttatgatacgtttcgctgtgattggtacgaactggatcactcgccagttcgtcgaggccgcccatgagagcggtaaatacaagttaaccgccgtatattcccgcagccttgaacaggcccagcacttcgccaatgatttttctgtcgagcatctgtttacctcgctggaagcgatggcggaaagcgatgccattgacgcggtgtatattgccagcccgaattccctgcatttttcccagacacaacttttccttagccataaaattaatgtgatttgcgagaaaccgctggcgtcgaatctggcggaagtggatgccgccattgcctgtgcgcgggaaaatcaggtggtgctgtttgaggcatttaaaaccgcctgcctgccgaactttcatttgttgcgccaggcgctgccgaaagtcggcaaactgcggaaagtctttttcaactattgccagtattcctcgcggtatcaacgttacctggatggtgagaatcccaacacctttaatccggcattctctaacggttcaattatggatatcggtttttactgtctggcgtcggcggtggcgttatttggtgagccgaaaagcgtgcaggcaaccgccagtttgctggcaagcggcgttgacgcccagggcgtggtggtgatggattacggtgatttcagcgtcaccttgcagcactcaaaagtcagtgattctgtcctggcgagcgagattcagggcgaagcaggatcgctggtgattgaaaaactgtctgaatgccagaaagtgtgcttcgtgccgcgtggcagccaaatgcaggatctcacccagccgcagcatattaataccatgctctacgaagcagagctgttcgctaccctggtggatgagcatctggtggatcatccagggctggcggtcagtcgcatcaccgccaaactgctgaccgagatccgccgccagactggggtgatttttccggcagatagcgtaaaactataattgccaaagtaaaacagtgtaaaaggtatgtaacagaccattgactggctgaatggtctgtcatactttgttacctgcaaaggggagtaacttcattgccggtcgatcgtcattacgatgtgtgaaaaaacacatccggtcaccgggcaacccgaaaggaatacgcagacgtattccttttttgttgtaagtgagaccttgccggaaggcgaggtctatgcataaaaagcagcggctgacgtcttccgacgttggccgtttttttatgtgtaaggaacttctatgaatactgtcggcacgccgttgctatggggcggattcgctgttgttgtcgccattatgctggctatcgacctgttgttgcaggggcgtcgtggggcacatgccatgaccatgaaacaggctgcggcctggtcgctggtctgggtgacgctgtcgttactgtttaacgccgctttctggtggtatctggtgcaaaccgaaggtcgcgccgttgccgatccacaggcactggcctttctcacaggttatctgattgagaaatcgctggcggtcgataacgtctttgtctggctgatgttgttcagctatttctctgttccggcggcattacaacgccgcgtgctggtgtatggcgtgctcggggcgattgttctgcgtaccatcatgatcttcactggcagctggctaatttcgcagttcgactggatcctgtatatcttcggtgccttcctgctgtttaccggcgtgaagatggcgctcgcccatgaagatgaatcaggcattggcgacaagccgctggtgcgctggctacgcggtcatttgcgcatgaccgacaccatcgacaacgagcatttctttgtgcgtaagaatggattgctgtacgccacaccgctgatgctggtactgattctggtggaattgagcgacgtgattttcgccgtggatagcattccggctatcttcgccgtgaccactgacccgttcattgtgctgacctcaaacctgtttgcgatcctcggcctgcgtgcgatgtatttcctgctggcgggcgtagcagagcgtttctcgatgctcaaatatggcctggcggtgattctggtgtttatcggtatcaagatgctgattgtcgacttctaccatattccaatcgccgtctcgctgggcgtggtgtttggcattctggtgatgacgtttattatcaacgcctgggtgaattatcggcatgataagcagcggggtggataatttttaatctgcctaagccgtgtaccctgtcattaacatgagcaccgttttctccctctcccttccagggagagggtcggggtgagggtaatttttcgcaccgatgctggcctgttcccctcaccctaaccctctccccaaacggggcgaggggactgaccgagtccttttttgatgttgtcatcagtctggaagccgcacgttggctttatttttatgtcaaagaaatgtaaccattaagtttcaaaatatgacctctctttaaaatccagcatttttcgcttcccgaagctgtaactttccttatactcgaccttgcaaacactttgttacatcctgaaagatgcgtcgacagaacgcaccagggatgtgcgacaacacaatgaaaggatcgaaaaatgactacgcaacgttcaccggggctattccggcgtctggctcatggcagcctggtaaaacaaatcctggtcggccttgttctggggattcttctggcatggatctcaaaacccgcggcggaagctgttggtctgttaggtactttgttcgtcggcgcactgaaagccgttgcccccatcctggtgttgatgctggtgatggcatctattgctaaccaccagcacgggcagaaaaccaatatccgccctattttgttcctctatctactgggcaccttctctgctgctctggccgcagtagtcttcagctttgccttcccttctaccctgcatttatccagtagcgcgggtgatatttcgccgccgtcaggcattgtcgaagtgatgcgcgggctggtaatgagcatggtttccaaccccatcgacgcgctgctgaaaggtaactacatcgggattctggtgtgggcgatcggcctcggcttcgcactgcgtcacggtaacgagaccaccaaaaacctggttaacgatatgtcgaatgccgttacctttatggtgaaactggtcattcgcttcgcaccgattggtatttttgggctggtttcttctaccctggcaaccaccggtttctccacactgtggggctacgcgcaactgctggtcgtgctggttggctgtatgttactggtggcgctggtggttaacccattgctggtgtggtggaaaattcgtcgtaacccgttcccgctggtgctgctgtgcctgcgcgaaagcggtgtgtatgccttcttcacccgcagctctgcagcgaacattccggtgaatatggcgctgtgtgaaaagctgaatctggatcgcgatacctattccgtttctattccgctgggagccaccatcaatatggcgggcgcagcaatcactattaccgtgttgacgctggctgcggttaatacgctgggtattccggtcgatctgcccacggcgctgctgttgagcgtggtggcttctctgtgtgcctgtggcgcatccggcgtggcgggggggtctctgctgctgatcccactggcctgtaatatgttcggtatttcgaacgatatcgccatgcaggtggttgccgtcggctttatcatcggcgtattgcaggactcttgcgaaaccgcgctgaactcttcaactgacgtgctgttcactgcggcagcttgccaggcagaagacgatcgtctggcaaatagcgccctgcgtaattaattgtttaacccctttcgtctacggcggaaggggttttctcaactttaaacggatcaattccccttttctgcatccgccagaaacgaatgatattcaggccattcataagcagaaaactaccctcaatcatcgtgccgcctatcgaccccgcccagaagttgtgaatcacccagcaacacgttgaaaaccacattacgcagcgcatggtcagccctttacagcagaatagcgcccaggtactgacaatcgtgccgataaccggcaatagttcgacaggatgatggaacttcgcgaggccaattccgccagtcagcacaataaaaatcgccattacccataagctgcgcgtgcgtaaggtaatcaatgtacgaatggcattaaggatggcactggcaccagcgggataggtgcccagaagaaaaaaatgtacgccaataacggcgctatagaccgaaagctgctttttgaagcgacgttcgtcacgattgaaaaatgttgtgataccaatcagaaaggcgatgacacccacgccctgggccagccaatacgcggtcatgataaatccttagcaggtatggaaaagcaaacggcgcttcacattatgaaacgccgttttttattaacaactcatttcgactttatagcgttacgccgcttttgaagatcgccagttcgcggaagtcgttacgctcgttacaggtttgcttaccgttggcaaactcaacgatggtgtcgataaattcttccagcaactgcggcatcgctttaccgtggatcaactgacccgcgtcaaagtcgatccagtgttttttcttcgccgccagttcactgttggtggcgattttcaccgtcggcacaaatccaccatacggcgtgccacgaccagtactgaacagcaccatatggcagcccgcacccgccagggcgctggtcgctacggcatcgttacccggcgcacttaacaagttcagccctggcgttttcagacgctcgccgtaacgcagcacgtcaaccacgacgctggaacccgctttctgggtacagccaagtgatttgtcttccagcgtggtgataccgcccgctttgttccccggcgatgggttttcatagatcggctgatcatgggcaataaagtactgtttgaagtcgttgaccatggtgaccagtttttcaaacgttgcttcgtcgcggcaatggtccatcagcaactgctctgcgccaaacatctccggcacttcggtcagtacggtagtaccgccgttagcaatcacgtagtcagagaaacgccccagcatcgggttagcagtaataccagaaagaccgtcagaaccaccgcactccagaccaaacttcagttcgctgagtttgcctggctcgcgtttatcgttgcgcatcacgttatacagctgatgcaaatgctcgattccggcttcgatctcatcatcctgctgttggcagatcatgaaatgaacgcgttcaggatcgatatcgcccagcgtttcacggaatgcggcaacctggttgttttcacagcccagaccaatcaccagcactgcgcctgcgttcgggtggcgcaccatgttttgcagcatggtgcgggtattaatgtgatcgtcgcccagctgtgagcagccgtaggtgtggctgaagaggaacacgccgtcagtaccttcggcgttgttggtctctttcagaaaacggttctggatctgccgcgcgatgccgttgacacagcccacggttggcaggatccacagctcattacgcaccccgacatcgccgttagcgcgacgatagatctgcacttcacgatctgccgcttgcgcaggcagatcctgaaaatcaggttgatagcgatactgatccagatcgctcagattcgtgcgcgtattgtgggcgtgaacgtgaacacctgccgcaatatccgccaatgcataaccaatcggcaggccatatttgatgacattggccccttttgcgatatccgttaacgcaaatttatgtccacgagcaacatcctggcgcagcgtaacagtctggttatcgacactgacttctgtgccttcagccaaatctgctaaagcgaccgcgacgttatccagcgcatggatcttgatgtattgcatatcaaccccagaccttagttcagttcaatggcgaagtagtcacgcgcattgttaaagcaaatatttttcaccatctcgcccagcaggttgatgtccgccggtgcttcgcccgcttccacccagcgaccgatcatctggcacagaatgcggcggaagtattcgtgacgggtgtatgacaggaagctacggctgtcagtcagcataccgacaaagcggctcagcagaccgagctgcgccagttgggtcatctgacgttccataccgtctttctgatcgttaaaccaccagccggaaccgaactgcattttgcccggcataccttcgccctggaagttaccgatcatggtgcccagcacttcgttatcgcgcgggttcaggcagtacagaatggttttcggcagcaggttttcttcattctgcttgctcagcaacttagacagctcttccgccatcggacggtcgttgatggagtcaaagcctacatccggccccagcagtttgaactgacgcaggttgttattacgcagcgcgccaatgtggtactgctgtacccagccgcgacgtgcatattcggcaccaaggaacaccagtaccgcagttttgaactgcgccacttcgtgctcgctcagggtttcgccagccagacggcgcgccagaatgctgtccagttccgcttcgttcgcttcagcaaacatcaccacatccagcgcgtggtcagacactttacagccgtgagcggcgaagtgatccagacgtttggtcagggcagtttgcaggtcagcaaagcggcgaatgtcggtatcggaaacttcgcccagcttcgccatgtagtcgttaaaggtcgcctgttcgatgttgaaggctttgtccggacgccagctcggcagcactttgatggtgaaagagccgtctttggcgatctctgcgtgatgctccagagaatcgatcgggtcatcggtggtgccgaccattttcacgttcatctgctgcatgatgccgcgcgcggagaagttatcctgcgccagcagttcgttacattcgttccagatttcatcggcagttgacggagaaagcaatttgccagtgataccaaacggacggcgcagttcgaggtgcgtccagtggtataacgggttgccgatagtgtgcggaacagtcgccgcccaggcgtcaaatttttcacggtcagacgcatcaccggtacacagacgctcggccacaccgttggtacgcatagcgcgccatttgtagtgatcgcctttcagccagatgtcatacaggtttttaaaacgatagtcttccgcaatctgctgcggcggcaaatggcaatggtaatcgaaaatcggctggtcttttgcgtagtcgtgatacagacggcgggcaaattcggtatctaacaggaaatcttcagtcataaacggagtcattttcgtcttcctctcaacgagtgagctagcttgcttatggtgcgatgctgacaaagttatcacaccaatttccagagtccgaagatattttcgtgagttagatcaataaacgtagttaaaaaaattactctcaaagtggtaaatctcgctgcaggccgcgccagtactggccttgctgtcgtcaggtaatgtccctacaaatattcccacatttgtgatggctctcaccttttaaagttgtatgacaagttatctttctgccgtcgcaaatcataagtcgacggaatgcaaattgccgattcattcatttgttagatgaatcgggttaaccggtacggaagccgaattagcacgaaactttcatggcaacgttcggggcgtgccggttttttttcggttacccggtcgtaactaacatcttcagcctctggcgggatgatggccgcgcttcctgcggatataacaaaacgatgaggttttacatgcgtaaaattaaagggttacgttggtatatgatcgcactggtgacgctcggcaccgtgcttggttacctgacgcgtaacactgtggcggcagctgcgccaactctgatggaagagttaaacatctccacccaacagtattcctatatcatcgcagcctattctgctgcttatacggtcatgcaaccggtagcaggttatgtactggatgtgctgggtacgaaaatcggttatgcaatgtttgctgtgctgtgggccgtgttctgtggtgcaaccgcgctggcaggtagctggggtggcctggctgttgctcgtggtgcggtcggtgccgcggaagcagcgatgatcccggcgggtctgaaagccagctccgaatggttcccggcgaaagagcgttccatcgcagtaggctactttaacgtaggttcttcgattggtgcgatgattgcgccgccgctggtggtatgggcaatcgtaatgcacagctggcagatggcatttatcatctccggtgcattgagctttatctgggcgatggcatggctgattttctataaacatccgcgcgaccagaagcatctgaccgatgaagaacgcgactatattattaatggtcaggaagcccagcaccaggtgagcacggcgaagaaaatgtccgttggtcagatcctgcgtaaccgtcagttctggggtatcgcgctgccgcgtttcctggcagaaccggcctggggtacttttaacgcgtggatcccgctgttcatgtttaaagtttacggctttaacctgaaagagatcgcgatgttcgcctggatgccgatgctgtttgctgacctcggttgtatcctcggtggttacctgccgccgctgttccagcgttggtttggtgtgaacctgatcgtttcccgtaagatggtcgtaacgctgggtgcagtgctgatgattggcccgggtatgatcggcctgttcaccaacccgtatgtcgcaattatgctgctgtgtatcggtggttttgcccaccaggcactgtctggcgcgctgattacgctctcttccgatgtgtttggtcgtaacgaagtggcaacggcaaacggtttaaccgggatgtccgcatggctggcaagtacgctgtttgcgctggttgtcggtgcactggctgacaccatcggcttcagcccgctgttcgcagttctggcagtgttcgacctgttaggtgcgctggttatctggaccgtgttgcagaacaaaccggcgattgaggtggcgcaggaaacacataacgatcccgcaccgcaacattaacgtttcgtgtaagttttagtttcccttcaaagccgccttctcaggcggctttttcatcactgcgagtagagctaaactcgcaaaagtggtataacaaatatagtctgccgtatcatgcctggagcgcatatggaaatcactgaaccacgccgtttgtatcaacaacttgccgctgacctgaaagagcgcatcgaacagggcgtctatctggtgggtgataaactgcctgcagaacgctttattgccgatgaaaagaacgtcagccgtacggtagttcgtgaagccatcatcatgctggaagttgaaggctatgtcgaagtgcgtaaaggttcaggtattcatgtggtttccaaccagccgcgccatcagcaggcggctgacaataatatggaattcgccaattacggtccgtttgagttgcttcaggctcgccagctcatcgaaagtaatattgccgaattcgcggcaactcaggtaacgaaacaggacatcatgaaactgatggccattcaggaacaggcgcgcggcgaacaatgcttccgtgattccgagtgggatttgcagttccacattcaggtcgctctggcgacgcagaactccgccctggcggctatcgtggaaaaaatgtggacccagcgtagtcataacccgtactggaaaaaactgcacgaacacattgattcccgtaccgtcgataactggtgtgatgaccacgatcaaatcctcaaggcgctgattcgcaaagatcctcatgctgctaagctggcaatgtggcagcatctggaaaacaccaagatcatgttatttaacgaaaccagcgacgacttcgagttcaatgccgaccgctatctattcgccgaaaacccggtggtgcatctcgatacagccaccagcggcagtaaatgaaattcctgtccgacaggcgctgcaatgcgcctgtttgtctcgtcggtaagcgaaaagtataaagtgtcagcctgtgtaaatcctctcgccaccctcccctgcattcagcaaaatcagactccacggacatgtaattttgataacgaacaacgttgacctttgttacaattagattcaatttgaatttatgtttttgaatgctttcttatctcacgatttaacagggaatagttcaggctgtgttgatgtatcaaacccgcagaacataccaaaacagcaataacattgcggtagtgcatcttttaaaaccagcgtggcgttaaccgattcaccaggaataatgaatggaacttttgacccaattgctgcaagccctgtgggcgcaggattttgaaaccctggccaatccatcgatgattggcatgttgtattttgtcttgtttgtaattttgttccttgaaaacggcttgcttccggcggcctttttaccgggcgacagtttactggtattggtcggcgtgttgattgcgaaaggcgcgatgggctatccgcaaacgattctgctgctgaccgttgccgccagcctcggctgctgggtcagctatattcaggggcgatggctgggcaatacccgcaccgtacaaaactggctatctcatttacccgcgcattatcatcaacgcgcacaccatctttttcataaacacggtttatcggcgctgttaattggtcgctttattgcgtttgtcagaacactgctgccgacgattgccgggttatcagggctgaataacgcgcgctttcagtttttcaactggatgagcggtctgctgtgggtattgatcctgacaactctgggttacatgctcggcaaaacgccggtatttttaaagtacgaggaccagctgatgtcatgcctgatgctgctcccggtggtgctgctggtgtttggcctggcaggttctctggtcgtgttatggaaaaagaaatatggaaatcgggggtaagggatgcaaatacctcgcatgtcgcttcgccagctagcctggtccggcgctgttttacttctggtcggcacgctgttgctggcctggtccgcggttcgccagcaagagtctacgctggcgattcgtgccgttcatcaaggcacaacgatgccagacggtttttcaatctggcatcaccttgacgctcatggcattcctttcaaaagtatcacccccaaaaacgacactctgttaattacatttgactccagcgaccagagcgccgccgcaaaagcggtcctcgacagaacattgccccatggctacatcattgcgcagcaggacaataacagtcaggctatgcagtggctgacccggttacgggataactctcatcgcttcggataacttcctgttatccgaaacatatcactcactttggtgatttcaccgtaactgtctatgattaatgaggcggtggttaacactaccgcttcgttgtctggacaatcgttcctttgtaataggtccgaatcacaatggaaggttcaagaatgaaataccgcatcgctttagctgtttctctctttgctcttagtgccggtagttatgccactaccctgtgtcaggaaaaggagcaaaatatccttaaggagatcagctatgccgaaaaacaccaaaaccagaatcgtattgacggtctgaataaagccctgagtgaagtccgggccaactgttcagatagccagctgcgtgccgatcatcagaagaaaatcgcaaagcagaaagatgaggtggcggaacgccagcaagatttagccgaggcgaagcaaaaaggcgatgccgataagattgccaaacgcgaacggaaactggcagaagcgcaggaagagctgaaaaagctggaagcgcgcgactactaactcacaatagtcactacttactcacctggagaaaactatgtcgaaagaacacactacggaacatctgcgtgctgagttgaaatccctttccgatacgctggaagaggtgcttagctcatctggcgagaagtcgaaagaagagttgagtaagattcgtagcaaagcggagcaggcactgaaacagagccgttatcgcctgggtgaaaccggtgatgccattgccaaacaaacccgtgtcgcggcggcgcgtgccgatgagtatgtgcgcgaaaatccgtggacgggcgtgggcattggcgctgcaatcggtgtagtgctcggcgttctgctgtcgcgtcgttaattatggcggacactcatcacgcacaagggcccggtaaaagcgttctgggcatcgggcagcgaattgtttctatcatggttgaaatggtagagacacgtctgcggctggcggtggtggagctggaagaggaaaaagcgaatctctttcaacttttactgatgctgggcctgacgatgcttttcgctgcatttggtcttatgagcctgatggtgctaattatttgggcggttgacccgcaatatcgcctgaatgcgatgattgccaccaccgtggtgttgctgctactggcactgattggcggtatctggacgctacgtaaatcgcgtaagtctacgttgctgcgccatacacgccatgagttagcaaacgatcggcagctgctcgaggaggagtcccgtgagcagtaaagtcgaacgtgaacgacgtaaggcgcaactgcttagccagatccagcaacaacggctggatctttccgccagtcgtcgtgaatggctggagacaacaggcgcttacgatcgtcgctggaatatgctgctaagtctgcgctcctgggcgctggttggcagtagcgtgatggcgatctggacgattcgccatcctaatatgctggtccgctgggccagacgcggttttggcgtatggagcgcctggcgtctggttaaaacgaccctcaagcagcaacagcttcgcggttaacttccctctggccggagccattccggccttatccctcaaattttttgaagatttttgacagttttccttgctaacaatcatcattcaccacgtttatgattctctccatcgacagcaacgacgctaataccgcgccattgcacaaaaaaacaatcagcagcctgagtggcgcagtggagagtatgatgaaaaaattagaagatgttggtgtactggtagcgcgcattttaatgccgattctgtttattaccgctggctggggaaaaattactggctacgcgggtacccaacaatatatggaagcaatgggcgtcccgggttttatgctgccactggtgattctgcttgagtttggtggtggtctggcaatcctgttcggtttcctgactcgcaccacagccctgtttactgcgggctttacgctgctgacggcatttttatttcacagcaactttgctgaaggcgtcaactcgctgatgttcatgaaaaacctgacaatttctggcggattcctgctgctggcaattaccggtccgggcgcgtatagcatcgaccgcctgctgaataaaaagtggtaagcacgcgctatacttaacgataaaaaacgaggaggaagctcctcgtttttgctattggaggagagaaaaatgggtcaactgattgacggcgtctggcatgacacctggtacgataccaaatctaccggcggtaaatttcaacgttcagcttccgcatttcgtaactggctcactgccgatggcgctcctggccccactggcacaggcggttttatcgcagagaaagatcgttatcatctctatgtttcactcgcctgcccgtgggcgcaccgcacgctgatcatgcgcaaactcaaaggactggaaccgtttatttccgtttccgtagtgaacccgctgatgctggaaaacggttggacctttgatgacagttttccgggagcaaccggagacacgctctatcaaaatgaatttctgtatcagctttatctccacgccgatccacactacagcggacgagttactgttcccgtgctgtgggacaaaaagaaccacaccatcgtcagcaacgaatcagcagaaatcatccgcatgttcaataccgcgtttgatgcgctgggcgcgaaagcgggtgattactaccctccagccctgcaaacaaaaattgacgaacttaacggctggatttatgacaccgttaacaacggcgtgtataaagctggttttgccaccagccaggaagcttacgacgaggcggtggcgaaagtgtttgaatcgctggcacgactggagcagattttaggccagcatcgttacctgaccggcaaccagctaaccgaagccgatattcgcctgtggactacgctggtgcgttttgatccggtgtatgtgacccacttcaagtgtgataagcaccgcatcagcgattacctgaatctgtacggttttctgcgcgatatctaccagatgccggggatcgccgaaacagtcaatttcgatcatatccgtaatcattacttccgcagccataagaccatcaaccctacggggattatttcaattggtccgtggcaggatctcgatgaaccgcatggacgagatgttcgcttcggttaaaaaaaggcaccttacgaggtgcctctgataattagctaagtgcatgttgttcatgtcggatgtggcatgaacgccttatctgacatacaaaacattgtacattcaatagattgcataacccgcgcagaccagataagcgtagcgcatctggcgattttgcgcttgtcatcagtcttagcgcgccttcacggcactttattaattccttgaacgaatatttactgccatttcattcacgtctattcttaatttgctgctttaaaaacaagtgattgagcaaaattgaggcaaaaatggactggtatctgaaagtactaaaaaattatgtcggtttccggggtcgtgcgcggcgcaaagagtactggatgtttattctggtcaacatcatctttacgttcgtgctggggctgctggataaaatgttaggctggcaacgcgctggtggcgaaggcatcctgacgacaatctacggtattctggtgtttttaccgtggtgggcggttcagttccgccgcctgcacgacaccgaccgctcggcgtggtgggcactgctattcttaatcccgtttatcggctggcttattatcatcgtctttaactgccaggcgggtacgccaggcgaaaaccgctttggaccagatccaaaactggaaccttaaaacaaatctgctcgccggatgtctgactcatccggcttttatcattatgttgatgaatgaataatttactaatgtttatttaaaatatttcaatgtcgttatataaattacctataaaaaataaccatgtatttatcttaaatatcaaaacctttataacatccgaaaaagaaagatacgaatagcatttacacaatacccggaatagactttcgtcacttttaattaaagggatgtttttatgcagtggtatttgtccgtattaaaaaattatgttggtttctctggtcgcgcacgtcgtaaagagtactggatgtttactctgattaacgccatcgtcggcgctattatcaatgtcattcaattgattttaggtctggagcttccatatctgtctatgctttatttgctggcaaccttccttcccgtccttgcgcttgctatccgtcgcttacacgataccgaccgttcaggtgcctgggccttgctcttttttgttccgtttattggctggctcgtgcttctggtttttttctgcacagaaggtacttctggcagcaatcgttacggaaacgatccgaagtttggttcaaattaatcttagaattggggcgatatttcgcccctttttattaacaataataaatattattttccgttaaaaagtttgggaatttcccgcagacaccaggatttcgcttcccccatactgtcacgacgccaggccataataatatcgatctcgctggtcgattccgggctgacgacacgcaaccgcccttccgcaatatctttttcgaccataggatacggcatcgtcgccacgccaagccccgccagtaatgcctgacgtttatcttcaatcgtgctcaccgttaagcgcggctgtttgtccagcagctgtacggtcaacaccgggcgctcacgagcggtatccgccaccgcaattccacgatatttcacacgcgtcacttcagataacggttccggctcctgatgaatcgggtgatcaggcgcggcaacgtagacgttcattaacgtatagagcttgcgcgagttgatctccgacgaggaacgaaaatgcatatccggcgcgataacaatatccgcccgcccctgctccagccgttcccacgcccccgccagcacttctgtgatgattgccagttgggtattggcttttgccgccagtttgtcgattaacgggaaaaaggcaggtgtcggtaccagcgcttcggtcacaatggtgagatgcgtttcccaaccgcgcgcgagagcttccgcatcagtagtcagtttatctgcggcttccagcaaaacgcgccctcgctccaacaacatcctcccgacattggtgaatttggtacgatggcccgagcggtcaaacagcaccacatccagctcttcttccagtttttgcatggtgtagctaagtgcggaaggcacgcgtcccagctcatccgccgccgccgcaaaactgccccggcgatcgatcgcatccataacccgtagtgcttccagcgttaatgccctttctttggccatttcgttctcattcaggaaatttgaacataccgggcagaatatctggctaacaatgtagcgtccagccccttaccataaaaggaagtaaagagaggtcaagaattatgattactacccgaactgccaggcagtgtggacaagcagactacggatggttgcaggcccggtatactttttcctttggacactacttcgacccgaaattgttaggctatgcctccctgcgtgtgcttaaccaggaagtgctggccccaggtgccgcctttcagccgcgaacctatcccaaagtcgatattttaaatgtgattctggatggagaagcagagtatcgcgatagcgaaggcaatcatgttcaggccagcgccggagaggcgttgctgctctctacccagccgggtgtcagctatagcgaacacaatctcagcaaagacaaaccgttaacgcgaatgcagctttggctggacgcctgcccgcagcgagagaatccgctgattcaaaagctggcgcttaatatgggcaagcagcaattaatcgcctcgccagagggtgcgatgggaagcctgcaattacgccagcaagtgtggctgcaccatatcgtgctcgacaaaggcgaaagtgcgaatttccagttgcatgggccacgcgcgtatttgcaatcgattcacgggaaatttcatgcgcttacgcatcatgaagagaaagcggcgctgacctgcggtgatggggcgtttattcgtgacgaggctaacattacgctggttgccgattccccactgcgcgctttgctgatagatttgcctgtctagttgtttttacagggagatgatgatgagtaaaaaattggccaaaaagcgccagccggtgaagcccgtggtggcgaaagaacctgctcgcaccgccaaaaattttggctatgaagagatgttgagcgagctggaagctatcgtcgcggatgctgaaacgcgtttagccgaggatgaagctaccgcgtaaagacaggttgccggatgcggcgaaaacgccttatccggcctacaaaatccaacaacattaacgaattaaacaacccgtaggccggacaagatgcgccagcatcgcatccggcacgatccccaaaacctggcgtttatctggccttgctcgccataatctcgataatctgccgatccgtttgctgcatcgaatggcttgctaacgcacacaggttggcaatcgactgctcaacatcatgcgccacaatcccttcattgccggtcacggcggtatcatccagcgccattaacaccgctttccacgcagccgaagcactggtcgaaaccttcatcgcgcagctgttcgacgcaccatcgcaaatcatgccgctgacatcgccgatcatactgctgatcgccatcgagatggtttcataacgcccatccaccagccatgccatcccggcggcggcccccattgctgcggtcgttgcggcacacagcgcagacaaacgcggtaactggttatggatgtaaattgcgctcaaatgcgaaagcatcagcgcacgcgccagccgttcatcatccgctccgaagtgttctgctaccaccaccacaggcattgttgcggtaatcccctggttacccgagccggagttactcatagccggaagcgtagcgccgcccatacgcgcatcggatgccgcgctggtacgaatcacaatggatgaagagagatctttcgccagcaaaccgcgctcgcactgtttttccagcgtcgcgccaatatgcagcccccacttaccgctcaaaccttcctgcgataacgcacaatttagcttcgcggaatcgagaataaagcggatcgccgcaaacgggacttcattgacgaacttcaggatctcagccagcgtcgttctggaaagcaccgtcagcggagactcttgctcgccctctgccacacacgcctgctgggtaaacaccacaccatcgtgcgtctcgatatgcacaatgttggtatgcccgccgacgatggtgacacacgcccacttctcaccgttccagactttggcgcgtgagaagaggatttcatcgcaaggttcctggatcttaacggagactttccccgccgccagcagtgctttggcatcggcaattgcctgcgctgttgcgtctttcagcacttccagcccggcgttggcatttccacctaacgcccccagcgccgccgcaatcggcagccccaccattcccgtgccgggaacggtgacgcccagaccgttcttcatcagatttggcgaaacccaggcttctacacgttcaaccggaccttccagttctgccgcagcaaccgccgccgccagcgccagtgaaatcggttcagtacatcccagcgccggttttacttcctcctgaacggcgaggatgtaacgctgccataacggatttaaagtcgaatcaaacatattaaaaaccttaaaatttcaggtaaatcaagaaaatgccaggaacggagaaacacacagcaacaaaccagtgacgataatcaggtacagagacatccctttgtatttgtgcaatgctggtactttgtaaaccagccacgccgggatcaggcaccctaccatgccgaaaatcgggctacagatagaggtgaagctcaacaccggtgcgttcagtacgatggcgctccaggccagcaaaatggcgaaaatcatgatgccgcgctgaacgagattttcgttaatcttctcggcaggcatcttgcgacgcaggatgttcattacgatcccttgcgttgcttcgcgaaagcctaaatagacgccaaagaatgcagtcatgacagcaaagatattgagaatgacgctgaccactttcacccacgctgcgccgtcaccgctaataaactgtgcggcaatcgccagcgcggaaatattctgctcataggcttttaccgcttcgtcatgtcccatcgccagcgtgaacgacacggcgtagaaaaagacggtgacaaacaaaatgccaaacgcgatattcattgcccgcaatgctttatgccgcgccacttcaattgatttttcccgcgagcgataagagatcaccatcggacttaacgtctggataaacagaatcgacgtcagggtaaacggcagcgtaataatggcgtttttcaccagcagccccagcggcggtagcgaaccgacgttatacagatgccacattcccaccatcgacacgcccagcgccgcgaccaccagcagcttggtcagcaccatgccggtcgaaattttgaataacaatttctcgccgcgtgaggagatcgccaccagaatgcaaatcagtaccagaccataaaagggactgtctgacagcaacccttccgtcacgccgaaggtatgcaggtaggaagcactatcgttggtgatggcggtggaatagacgaacatccaaatcaccagcattacgaaatagagcgcacctaacaggatgccccagtttttacctaaataaccgctaatgacgctcgggtaatctttacattctggtgattctgccagcgtattaataaacaatcgctgaaacagatacattgccgggtaaccaatcaccgatgagagcaaaaatacccacaatcccatcaaaccgacctgcaccgggagaaaaacaatccccgcgccaatcgccatcccgatactcataatcacccagccggtgtcagtactgtcgaatttgatcgcttctcgccactcgctctcactcattccagcacgacccgccggggtcgaagcgtctgcaatgacgcctttattcgatgcaatttccataatttctcgctcaatattttgtagggcttattatttttttccgagccgcatcaaggcgatatgcggtctacgtttttgcaggcgagttattagaataaagaaatgatacgcgcgaggtcagagaaaatcttcacaatcaagactttgaaataacggagatggataagaattttctactaaattaatcgcaggagaatattcattctctatttgcggcagatcacaaaaaaaaggtgcacatttgtgcacccaaggatgaaagctgacagcaatgtcagccgcagaccactttaatggccagtcctccgcgtgatgtttcgcggtatttatcgttcatatctttgccggtttcatacatcgtctcgatcactttatcgagtgaaacacgcggtgccgaggtgcggcgcatcgccatccgcgcggcgtttactgctttcacggcattaatggcattacgttcaatgcacgggatttgtacctgtccggcaaccggatcgcaggtcagcccaaggttatgctccatcgcgatttccgccgcattgcatacctgcgccggactgccgcccagtagttcagttaaccctgccgccgccattgaacaggccacgccaatctccccctgacagccgacttccgcgccagagatggaggcgttcattttatacagcgcgccaatagcccccgcggccagaaaatagcgggcaattgaccgctcgtttaccggacgacggaacttatcgtaataagccagtactgccggaataatgccgcacgcaccgttagtcggtgccgttaccacgcgcccgccagctgcgttttcttcactaaccgccagcgcgtacatgttgatccagtcgatgacattcatcggatcgttagagatgttatcgctggaaaccagctgacgacgcagcgctacggcacggcgcggcacattgagcggaccaggcagcacgccttcagtgttcatcccacgttcaataccgtcatgcatcacttgccagatacgggcaaaaccggcgtcaatttccgctttgctgcgcagcgctagctcgttgtgcatcatcagaccagatatagacaggccgttgtaatcacacattttcagcagttcacctgctgagtggaaatcgtaaggtacggacgtttcgacatcgtgcgacaggccgaagtgttcttcttcgacaataaacccgccgccgacagagtaataggttttacttaatagctcttcctgtcccttccaggcagtgatccgcattccgttctcatggcgaggcaacatttcgggatggaagataatgttctttgctacaggaaaatcaacaatatgcgcaccagatgccactggcagccgcccgctgcgcgttactaactctataaatgcagggatctcatcaatgacaacatcctgcggactgtttcctgccagtcccatgatgatggcgacatccgtggcatggcctttgcccgtcagtgacaacgacccgtacagatcgaccacaatatggctcgtcgcggttaataagccgctactttccagccgatcaataaaactttttccggcattcattggccccacggtatgcgaactggagggaccaatcccaattttgaaaatatcgaatgcactaatcatatccacaccctcggattgccgttcagtgaagtggagcggaacgaccttacgaccgtcccgctcacgaggctttacgcactacgtactgcgatggcttcaatttccagcttcacatctttcggcaaacgcgcgacctgcacacagctccgggtcggataggtcgcctgatgctcatcgaagaactgcttatagacttcgttgatggtggcaaaatcattcagatcggtgataaacacggtcatcttgatgatatcgcccacgctcagcccggcagcaaccacgatcgctttgacgttttcgaggcttaaacgcgcctgatcttgcacatcagccgggatctcaccggtctgtgggcaaaccggtatttgcccggaggtgaagaccatgctgcctaaatcaacgccctgaacataagggccgattgcgcctggggcacgttgcgtttcgataatctttttcatacatcctccggcgtcagagcgcctgggtaaaggtacgtgaaataacatcctgttgctgttcacgggtcagtgcgttgaagcgcacggcgtagccagagacacggattgtcaggttaggatatttttccgggtgctcgatggcatccagcagcatttcccgattcattacgttgacgttgaggtgttgaccgccttcgacatccgcttcgtggtggaaatacccatccagcaggccgacaaggttggttttacgtactggatcttctttgcccagcgccgcaggaacgattgagaaggtgtacgagatcccatctttggcgtaggtgaacggcagtttcgccaccgacgtcaatgaggccacggcacctttgcggtcacgaccatgcatcgggttagcgcccggcgcgaacggtgttccggcgcgacgaccgtccggcgtattaccggttttctggccgtacaccacgttagaagtgatagtcagaatcgactgggtagggacggcgttgcgataggttggcagcgctttaattttcttcataaagcgttcaaccaggtcgcaggcaatgctgtctacgcgctcgtcgttgttgccgtactgcggatattcaccgtcgatttcaaagtccaccgccaggccgttttcgtcacggattggtttcacgcgggcatatttgatggcagacagggagtccgtcgccaccgacaggcccgcgatgccgcatgccatagtgcgatagacatcacgatcgtgcagcgccatcagcgaagcttcgtagctgtacttgtcgtgcatgtagtgaatgatattcagcgcgctgatgtactgcaccgccagccagtccatgaagtgatcgaggctgtccatcactttgtcgtaatccagcacgtcgtccatcagcggtgctgttttcggcccgacctgaatcttcagcttctcgtccaccccgccgttaattgcgtagagcagcgttttcgccaggttagcgcgtgcaccaaagaactgcatttgcttaccaatcaccattgggctgacgcagcaggcaatcgcgtaatcgtcgctgttgaagtcagtacgcatcagatcgtcattttcatactgcaaggaagaggtgacgatcgacacctgcgcggcatattttttgaaggcaatcggtaattcttccgaccaaagaatggtcaggttaggttccggtgccggccccatagtgtgcagggtgtgcaaatagcggaaggagtttttggtcaccagcgtacgaccgtccagccccatcccgccgatcacttccgtcgcccagattgggtcgccggagaacagcgaatcaaattccggtgtacgcaggaagcgtaccatacggatcttcatgatgaagtgatcgatcagttcctgtgcctgctgctcattgagtacgccagctttaaagtcgcgctcaatgtagatatcgaggaacgatgccgtgcggcccagcgacatcgcgccgccattttgcgatttcactgccgccagataagcgaagtagagccactgcaccgcttcctgcgcattctgcgccgggcgagagatatcaaagccatatttcgccgccatttcctgaatctgcaacagcgcatgacgatgctctgccagctcctcacgcagacggatggtggcttccagatcctcgcctttttccagacgagactggagatcggcaaattgcagttcgcgttcacgtaccagataactgatgccatacagcgctacgcggcgatagtcaccgataatgcgcccacggccatagccatctggtaaaccggtcagcacgccagatttacggcagcgcagcatatccggtgagtaaacatcaaatacgccctggttatgggttttacgcagatcggtaaacagatattcaaattcactgtccatttctcggccataggcgtggaatgaacttttaatcatattaatgccaccgaacgggtgtagcgcacgtttcaacggcgcatccgtttgcaggccaacaattttttccagcggctggttaatatatcccgcatcatgagcggtaattgtggtggcaatattggtatcgaaatcaaccggcgcgtgggttgcattttcgatacggatgccttccattactttttcccacaattccgtggtggcaggcgtcgcttcggcgaggaaagattcatcgccttcatacggtgtatagttatgttgaataaaatcgcggacattaatttcgtttttccagtccgtacctttaaagccaagccatgcgtcggcgtacagcttatcgctggtatcaatatctaccttcatgaaaaataatctctctacaatacttcaactaaattatgcaaattctgcgggcgcgttaactttgcctaaatgaatggcatccaaagcaatcattttttcttcgttagtcggaataacggcacaaatgacacgcgcattttcactggaaacaattcgctcaccacaggagttagagcgattattcatttctgtatcaatctctaagcctaatacagccaaatgttccatgaccagacgacgaattaagcttgaattctctcctattccgccggtgaatataattccatccaggcgacgtaatgaagctgcgtgtccggcaatatgacgggcaattcggtgaacaaaggttttaattgccagttgcgcgcgttcgtgaccttcatgccaggctttttccagaacacgtaaatccgaagaaagaccggaaatacctaataatcccgactctttattcactacgcgttccaggtcacccaggctctggttggtttggctggcgacccaggacatcgcaccaaagtcgacatcgccactgcgggtacccatcatcaagccttccagcggcgtcattcccattgaggtatcaacactctgaccgttgcgaaccgcgcagattgacgcgccattgccaagatgcgccacaaccaggccggagtcatcttccgccagattcagcagcgaatgtgcgcgctgggaaacatagcggtgcgacgtgccgtggaaaccataacggcgtacacctaactcttcataatatttccacggcaggccgtataaataagcttccggagccatcgtctggtggaaactggtatcaaataccgccacctgagttacgcccggaaataattgctgcgccgattcaataccacttaaattggcgtaattatgcaggggtgccagtggagaaacgcgacggatattatcaatgacttcatcggtaataatggcggactcggtaaaaatactgccgccgtgagcgatgcggtggccaattaaggccacactgtcatttaaattccgtttttccagttcaaatgcaattgccttcaatgcaccttcgtagctgtggtgagccagcggtgctggctctcccccatttacggataagaatgcattttccgagttaataccgtcggcaatacctgacattaatacttcacagtcgctggcatcgagcacggaaaacttaatcgaagacgaaccacagttaataaccaaaacaaccggaaattcattcatctcttttctcatcctgagttacggattaaaacagtttgtatacgatgttcaggatggtcagcagaccaatcacggtaacaaacacgttatccagacgaccacggtatttcgccagagacggcgctttacggatggcatacatcggcaacaggcacagcagggatgcgataatcggtgcgcccatggcttcaatcaggtcaaggatgttcgggttggcgtaggcaacaacccaggtggagcccatgatgaagatcatgctgatagtgttcagtttacccagcgacactttagttttgtcgcctttataaccaaacttcaggaccaggccattcagaccttccagcgttcccagatagtgaccgaagaaagatttgaagatagccacgagtgcgatgatggaagccgcatattccagtgtaatcgcgaacgttgttttggtaccggtcatggacgcaaagtggttagccagataagaaagcactggaatattctgcgctttggcttccgccatgttggccggagacagagtaaacaggcagctaaaggcaaagaacatcaccactgcaaccatcagcatgctggcacgagaaatgatttgggaacatttacgttcggtgaagtcgcgaccgaagtctttctcatactcttcacgcttagaaaccacgaaggaagagacgattggcgagaagttaaaggagaaaaccatgatggaaatccccagccagacagtgatcaggataccgtcatgaccggttaacgacagcgaaccgaggtcaacctggtcgataactgcagagttccagtaagggatcagcgacaaagaaatcagcaccaggctggcgataaacggccataccaggtagctcatcactttaaccatcagatccttaccaaaccagatgacgaaagccatcagcagcaacaggaacagcgccacaaagccgcgattcagcggtgcaaagccgagctggttttcccagaacgtcataaaggtattggtaatagtaacgccataaatccacagcagtgggcaaatcgcgaagaagtacaggaacgtgataaccacgccgccagttttaccaaaatgctcttccaccgtttccgtaatgttgccggaagggttagagccagaaagacacagacgcgccagcgcccggtggcaataaaacgcgatggggtatgccaataccaacatcagaagaatcgggatcagtccgccaaaacctgcgcggatagggaagaacagcaccccggcgccgattgccgtaccaaacaagcctaacgtccatgtggtatctgatttacgccaggacgattgttttgtctggctggatacaatgctatctgaagtactcatatcctatcctcaacgaattaattaagcgtcaacgaaaccggtgatttgagagacgcgagaaagatcgatattgccgccggaaataatactgacggtttttctgttttgaatatattggtctaatttaccgcttaataatgcagcacatgccagagcgcctgcgccttcggtgacgactttattgcgctgaattaaggcaatcatactgtttctgatttcgtcttcgctgaccagcacgatgtcatcgactaattcacgaacgatttcgtaagttaaattacccgggcgggagacatcacaaccatccgccagggtgccggtagttcggtgcgtggttatttctccggagtggaaagaagccgccatgccgtgaacgttttcagactgtacgccaataacacgaatggtcgggttaatagatttaattgccaccgcaataccagcaattaaaccgccaccaccaattggcacaatcacgttatcgacatcatagagatcttccataatttccagaccaatcgttccctggccagcaatcactttcggatcatcgtaaggtgggataaaaatacggccttccatttcgacaatttcgctcactttagcgatagtgtcgttgaagttatcaccatgcagaacgacttctgcggagtagtcgcacgttgccgctactttggattttggcgcaccttttggcatcaccactttaccgtcgatacccagcatcgcgcaggagagggaaaccccttgcgcatggttgcccgcagaacaggccaccacgcctttgcgtttttccgcatcggtcagtgaacttaatttattaaatgcgccacgaattttaaatgaacccgtacgctgcatattttcaaacttcaggaatatttcacctttgcaacgttcactaaaatagttggagcgaggcatgcctgttttataaattcgcccagccagtcgttgtttcgcttcaataatgtcatcaatagcaaccggcagatcgtatgtaatatgcattataaaacctcttcgcctgaattaaatatgtaggtaaccgtaaccgacacctgcaagacagacaggtggattatttatgtttaaataaaaacaaataactaaccaacttctattaattgccttcgtctacacccattataagatgaatactctttggctaattccaccaaaaccgatgctgcttttttaatacgataatttttcgaccataccgcggcatattgtgccacaggtaatgtttcttcaaccggaatagtaataaattgattagaaccaaaaggtgacgtcatatcacaaggaattacagttaagaaatcagcattgagaacaagattataaattgtcacgactgagtcggttttaacgatgttttcaatactgatgccatttctttgtaacgtagtaagcagttcgctgtagtaccccatattagtttgtggcaacacccactgttcgttcttcaacgactccagcgtggtggtgccggtgcatgttcgggacttactggctaccagcacaaactcggactcgaacagcggctcaacatgtaaatcctgaagcttcatttctgcacttaacgtaccaatcgcaaaatccagtcgaccgtcgcggattgccggtaagaacgaagacagttgcgcttcatacatagaaacctgcgctttcgggaacacctctttgaacttgttgatcatccctgacataaaagtaaaaccaatcaatgaaggaaaaccaaatgagacttccaccaccgcctcagaagacataccgcttatctcattaaccatatttttcatttcacgggtaatggattcggaacgggagagtaacaattgaccggcaggtgttaatgttacaccggtatttttccgcaccactaattccacaccaaaataatcttcaatatcgttaatgattttactgacggccggttgagttaaccctaattcttttgcagccgagccgatagaaccacttctaatgacttcctgaaagactaccaggtgctgcgttttcggaagaagaatagtgctcataacgacctacgttaattacctcattgacggcatgaagtgtatcaaaatgaaatgaacaggatatgtgcgaccactcacaaattaactttcaatactttccagagtatcgttattacaattaaatacctttaaatatcaacaagttaaagtataaaaatcagcataaaccctgatttttgtcaaaaaaaatgacggggataaccatattttatggcgataacatcattcgttatgtggttaatacaaaaaaggggctgagaccatatttcaagcaattaccggataattaccaggcaaaatttgagttaaatttaatgagcaagttctcaaattttattataaataaaccattttcagtgataaataatgcggcatgtcacattttttcacgctatttgttggagaacaaacatttattttatcaatattttaaaatttcgaatacatgtattgatcatctcgaacaattgattaacgtcaactttttctcttctgacaggacgtcattttgtgaatgcaatcgttttccataaattcttctcccctcataggcgacgaatagcattttgtgttgaggatcacaaaacgaataattgctgatcgccgcgataaggtcagacaaagacaacaagggaaattttcacagagcttttgatcggcgtaggccacagaatgttgcttcgtttactgtaacgccgggtaaatgagcgttttttgatagtgcgaaagaaccctgcgaggaaaataagcatctattattgtttgtcatgatgacaaggcaggcatcaatgaaaggcttcccaattgcgcatatttttcacccttcaatcccgccaatgcacgcagtggttaacaatcacaatagaaatattgattattggacggtaaaaagaaagtttgcagaaattgtctccaccaatgacgttaataaaatttacagtataagtaatgaactgcggagagtattatctgcaataactgcattgaatttctatcatggcgatgttccttctgtcatgatccgaatccaaccggaaaatatgagtccattcattatagatatttctacaggagaacatgatgattatatcatacaaacattagatgtaggcacttttgcaccttttggtgaacaatgtacttgctcagccgtcaataaaaaagagctggaatgtattaaggagacgatttctaagtattgtgcaaaattcacccgaaaagaagccatcttaaccccccttgtgcactttaataaaaccagcattacttcagattgttggcaaattctctttttttcacccgatcattttaataatgatttttattgattatttataaaggataaaataatgttccctgtttcatcaattggtaatgatattagtagtgatttagtccgtcgaaaaatgaatgaccttcctgaaagcccaacaggaaataacctcgaagcactagcaccaggtatagaaaaactaaaacagacctctattgaaatggtcactttacttaacacgttacaacctggtggaaaatgcattatcactggtgattttcaaaaagaattagcgtacttacaaaatgtaattctttataatgtctcgtctcttcgtctggattttttaggttataacgcccaaattattcaacgatcggacaatacttgtgaacttaccattaatgaaccgttaaaaaaccaggaaatatccacaggtaatatcaatattaattgcccattaaaagatatttacaatgaaatcaggaggttaaacgtaatttttagttgtgggactggagatatcgttgatctatcctctctggacttacgtaatgtcgatttagattattatgatttcacagataaacatatggctaatactattttaaatccttttaaattgaattcaacaaattttactaatgccaacatgtttcaggttaattttgttagttcaacacaaaacgccacaatctcctgggattatttactaaaaataacgcctgttttaataagcattagcgatatgtattctgaagaaaaaatcaagtttgtcgaaagttgtttaaatgagcctggagacattaccgaagaacaattaaaaattatgagatttgcaattataaaatctataccaagggcaactcttacagataaattagaaaatgaattaacaaaagaaatatataaaagctcatcgaaaatcatcaattgcttgaacagaattaaattaacagagatgaaagaattctcatcagaaaaaatatatgattacatcgatataatcattgaagattatgaaaataccaaagaaaatgcttatctggtcgtcccccaaattaattatactatggatttaaacatagaagactctagctcagaagagttactttcagataataccctcgagaaagacgaaaattctccggacaatggctttgaggtcggggaatataacacatatgaagcatataactcagagaagcaatattttaccagagaggactatacgtatgattacgaccttttaaatgcaatatagacttaataacttcttacaaagtctattattaataccgtagatatttattcatcttaccctgtgcaccaaaagcaaaaactcactgacgcgggtttgaaactgatggcaaccgcaaaaatgcctgatgcgctacgcttatcaggcctacgccatctctgcaatatattgaatttgcgtgcttttgtaggcaggataaggcgttcacgccgcatccggcatgaataaagcgcactcaacaatctgaaacccgccggaacggtttattacgtacatcaggtaaaactgaccgataagccgctttcttttgggtatagtgtcgtggacagtcattcatctttctgcccctccaaaagtaaaaacccgccgaagcgggtttttacgtaaaacaggtgaaactgaccgataagccgctttcttttgggtatagtgtcgtggacagtcattcatctttctgcccctccaaaagcaaaaacccgccgaagcgggtttttacgtaaaccaggtgaaactgaccgataagccgctttcttttgggtatagcgtcgtggacagtcattcatctttctgcccctccaaaagcaaaaacccgccgaagcgggtttttacgtaaatcaggtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccgcttgcgcgggccatcggcggtttgctctctgttgcactggtcgtgggtttcccccccaggcgttacctggcaccctgccctatggagcccggactttcctcccctccgcccgtctcccccgaagaggacgacgacgaagcggcgactgtctggtcagcttcggcgcgcagtatagagggtttgcgcgcccttgtcaccccgcgttgcgcattccaatcgccagtgtcgcggcgatattacgtgaagcacggcagatattgtcataagccccgcggaatgcttcgtccaacgtacctatgctggtcaatacgctgaagaccgcatcaatgccatgctgatgtacaacgccaacatcatcggtcaggctacccgcaatgccaatcaccggtttatggtacttcttcgccacgtttgcgacaccaatcggtaccttcccgtgaatactctggctgtcaatacgcccttcaccggtgatcaccagcgtacaatcgtgaatatgttcctccagattcagcgccgtagtgacgatttcaataccacttttcagttccgcaccaagaaacgccattagcgccgcgcccataccacccgcagctcctgcaccggggacatctttcacatcaacatgcagcgcttttttaatgacctcggcatagtgagagaggttattgtccagctcaacaatcatcgcttcactggctcccttttgtgggccaaagatgcgcgatgcgccgttatcgcccaccagcggattggtgacatcacaagcgacgcgaatgacgcaatcttttaagcgcggatcgaggccggaaatatcaatatcattcagagtattaagactaccgccgccaaaaccaatttcattgccgttggcgtcgcataatttcgcccccagcgcctgtaccatgcctgcgccgccatcatttgtagcgctgccgccaatgccgataataatgtttgtcgcaccgctctccagcgcctgcaggattaactcgcctgtgccgcgtgaagtggtcacgagtggatcgcgtttttccgcaggtaccagctccagcccactggccgccgccatttcaataaacgcggttttgccatcgccggagatcccccaactggcattcactttctcgcccagcggccctgtaacccaggcgtgacgttcagccccctgggtggctgcaatcatcgcttccaccgttccttcgccaccgtcggcaaccggaacagaaacgtactgtgcatcaggaaaaatttcccgaaatcctttttctatcgcctgcgcaacctcgctggcagataaactttctttataagagtctggggcgattacgattttcatacctatgcctgttaccacatgacgccggagggcgtttctcttattcggcctggattccaggcccggattgcaatacgccatccgggcacgacgtcattaacgagtaacttcgactttcgccagtttttcgtagtagcacgccagggcgctatgatccgccgttcctaaaccatctgctcgcagtgcctgcatcatctccataaccgcagctgtgagcggcagttgtgcgccgacgccgtgagaagtatccagcgcattcgccagatccttaatatgcagatcaatacggaagcccggcttgaagttgcggtccatcaccatcggcgctttggcatccagcacggtactgcccgccagtccaccgcgaattgcctgataaaccaggtccgggttaacgcccgctttagttgccagcgttaacgcttctgacatcgcggcaatattcagcgccacaatgacctgatttgccagtttggtgacgttacctgcaccgatttccccggtatgcaccacggaacccgccatcgctttcatcaaatcatagtatttgtcgaaaatagccttgtcgccgcccaccatcactgacagcgtaccgtcgatggctttcggttcaccgccgctcaccggagcatccagcatatcaatgcctttcgctttcagcgcttcgctgatttcacggcttgccagcggtgcgatagaactcatatcgatcaataccgtacctggcttcgcgccttcaataatgccattctcacccagcgccacctctttcacatgaggggagtttggcagcatggttatgatgacgtcgcactgttcagcgatcgctttagccgtagacgctgtttctgcacctgcagcaatcacgtcagcaatagcttctgggttacggtcagcaaccaccagcgagtaacctgctttcagaaggtttttactcattggtttacccataatccccaggccaataaaaccaactttcatagtcatatcaatcatctctcttgttgcggtggtggttattttttaaaggtatcagccagtttctgagtggcagagcggaagacgccgagatcgctgccgacagccacaaacgtcgcgccccattccagataacgacgcgcatcggcttcgaccggcgcgaggataccgctgggtttgccgtgcgcgctggcacggttaaaaatgtgctgaattgctttttgtacatccgggtgtgatgcattgccgagatggcctaatgccgcggccagatcgctggggccgacgaagatgccgtctacgccttcggtagcggcaatggcatcgacgttatctacgccctgctgactttctatctggaccagaatagtgatgttcttgttcgactgagcgaaataatccgccacggtgccaaacatattggcgcggtgagaaacggagacgccgcgaatgccttccggtgggtaacgggttgatgccaccgccagctctgcttcctcttttgtttctacaaaaggaatcaggaagttatagaaaccgatatccagaagacgcttaataattaccggctcgttggtcggcactcgcactactggcgcgctggcgctgcctttcaaggccattaactgcggaataaacgtggagatatcgtttggcgcatgttcgccatccagcaccagccagtcaaacccagccaaaccaagaacttcagtgctaatcgggttagagagtgctgaccagcaaccaatttgtacctgtttcgcagccagtgcggctttgaatttattcgggaaaacatcgttattcatcgcttatacctttgcttatttctgcaattccatacgtttaatgtcgccaactacgaagaggtagcagaccatcgccatcagcgctgaacatcccacgaaaaccagtgctgcattgaaggagtgcagttcacttaccaggtagccaatcaccagtggagtgacaatggaggcaacattgccaaagacgttaaagacgccgccgcagaggccaacaatctctttcggcgcggtgtcagaaatcaccggccagcccagcgcaccaaatcctttgccaaagaaagccagcgccatcagcatgaccaccagcgtggtgttgttggtgtagttacataagatgatggtggaagccagcaacattcccagcacaatcggtagcttacgtgccagggtcagggataaaccgcgtttgatcagataatccgagaagacacctcccagcacgccgcccgcaaaaccacacagtgctggaatcgaggcgaccagacccactttcagaatcgacatgcctttttcctgcaccagataaatcgggaaccaggtgaggaagaaccaggtgatggtgttgataaaatattgtccgaaaaatacgcccagcatcatgcggttagagagcaattgcttgatgtaatgcagtttgggtccgcttgctgccgcactgcccggctttttgtggtccatatcgaccaccgcgccattttcagagataaacttcagctcttccgcagacatacgtgggtgatctgtcgggttatgaatcaacttgatccacagcgccgtcagcacaaaaccaatcacccccataacggtaaagacgtgctcccagccccaggcgaaagtcagccagccaagcagcggcgaaaagagcgccagcgagaaatattgcgccgagttaaagatggcggaggcagtaccacgttctttcgtcgggaaccaggcggcgacaattcgggcgttcgccgggaatgatggcgcttccgagaagccgagcataaagcgcataaagaacatggagatccctgcccaggccagcgggaacatatcaacaaagccttgcaggaaggtgaatagcgaccagaaaaagaggctgtaggtgtaaacttttttcgagccaaacttatcaagcagccagccgccggggatttgcatcagcaagtaggcccagccaaaagcggagaagatgtaacccatcgaaaccgcacttaactgcaactcttttgccacttcggtaccagcaatagacagcgttgcacgatcggcgtagttaacggcggtaacaataaaaataatcagtaatattaaatagcgggtatgcacgcctttctttttttcgtcaacggtgtccagaatcattttatttacctcgggtacttatgctgatttttattattatggggaaggtgttatttatgagtttcatttatgccgtaacgacaatgaactcgggaattagtataagcagcgcgagaataataatcattgtgcaaatgctaatttaattaatactatttaaatattattttgagcatatgcacataaggttgcgcgctaaagcacagatttgcgctttaccttaccgggcggcactgcaatccctgaaatgattgacattgatcacatttctgcgtttaaactcctgacattcttatttcacccaatgaagtcatttatttttaaatgagaccaggtcctcattttaataacccctggctggagaatattgcacaatggccaacatcgaaatcagacaagaaacgccaactgcgttttatataaaagttcacgacacagataatgtggcaattattgttaatgataatggcctgaaagcaggaacgcgttttccggatgggctggaattaattgaacatattccccaggggcataaagtcgcattgctggacattccggctaatggtgaaattattcgttatggcgaagtgattggttacgccgtgcgtgcaatcccacgcggaagctggatcgacgaatcaatggttgtactaccggaagcgccgccgttacacacgctgccactggcaaccaaagtcccggaacccttaccgccgctggaaggatacacctttgagggctatcgcaatgccgatggcagcgtgggcaccaaaaacctgctcggtatcaccaccagcgtccactgtgtggcaggcgtggtggactatgtagtaaaaatcattgaacgcgatctgctaccgaaatacccgaacgtcgatggcgtggtggggctgaatcatttgtacggttgtggcgtggcgattaacgcaccggcggcagttgtacctatccgtaccattcacaatatttcgctgaatcctaactttggcggcgaagtaatggtgattggcctgggttgtgaaaagttgcagcctgagcgcctgctgactggaacggatgatgtgcaagctattccagtagaaagcgccagcattgtcagtttgcaggatgaaaagcatgtcggttttcagtccatggtcgaggatattttgcagatcgccgaacgccatctacaaaaactgaatcaacggcagcgagaaacctgcccggcttcagaactggtcgttggtatgcagtgcggtggcagcgatgcgttttctggtgtaacggcaaacccggcggttggctatgcgtctgatctactggtgcgctgcggcgcaacggtgatgttttcagaagtaacggaagtgcgtgacgcgatccatctgctgacaccacgcgcagtgaacgaagaggtcggcaaacggctgctggaggagatggagtggtacgataactatctcaatatgggaaaaaccgaccgcagcgccaacccttcgccgggcaacaagaaaggcggtctggcaaacgtggtagagaaggcactcggctccattgctaaatcgggtaaaagcgcaattgttgaagtgctgtcgcccggtcaacgcccgactaaacgcggattaatttacgccgcgacgccagccagcgattttgtctgtggcacgcaacaggtggcttcgggtatcacagtgcaagtgtttacgaccggtcgtggtacgccgtacggcctgatggcggtacccgtcattaaaatggcaacccgcaccgagctggcgaaccgctggtttgatttaatggatattaatgcgggcaccatcgctaccggcgaagaaactattgaagaggtgggctggaagttgttccactttattctcgacgtcgccagcgggaagaagaaaaccttctcggatcaatgggggctgcataaccagctggcggtgtttaacccggcaccggtgacctgatttcttttggaacgtccctcgcaaaacatggccttagtgccatgtttttattgtttaaagcccccacgtccattaataatgcatttgcattaccttagttcaagcttataatttgagcagaaaacaggctgtaaaaggacagtgaatcatgcccgctaatgctcgctctcacgctgtactgaccactgaatcaaaggtcacgatacgcggacaaacaactatccccgcgccagtgcgtgaggccttaaaactgaagccaggccaggacagcattcattacgaaattctgcctggtgggcaagtatttatgtgccgactgggagatgaacaggaggatcatactatgaatgcatttttgcgttttctggatgcagatatccagaacaacccgcaaaaaactcgtccattcaacattcaacaaggaaagaaacttgtcgctggcatggacgtcaacattgatgatgagattggcgacgacgaataatggattttccacaaagggttaatggttgggcgctatatgctcatccctgttttcaggaaacctacgacgctttagttgccgaagtcgagacattaaagggaaaagatcctgaaaattatcagagaaaagccgccacaaagttattggcggtagtccataaagtgattgaggagcatatcacggtcaatccatcatcaccggcattccgtcatggcaagtcgttaggctctgggaaaaataaagactggtcacgggtaaaatttggtgctggtcgttatcgtctcttctttcgttatagtgaaaaagagaaagtcatcattctgggatggatgaacgatgaaaacactctgcgcacctacggtaaaaaaacagatgcctataccgtattcagcaaaatgttaaaaagaggacatcctcctgccgactgggaaaccctcacccgagaaacagaagaaacccattgatggtgttcacaatgcccgccgaacgcattcgtgttgaccagcgggcatcctttctcactccccgaccagaatcacttcaaccccagcctttcgcagtccttccaggctatccgcaggaatgccttcatcaacaatgatcatgtcgatacgttgagtatcaatgatcttatgtaaactggaacgattgaacttactggaatcggtgaccacgatgatccgttccgcaacttcgcacatccgacggtttaaacgagcttcatcttcattatgtgtgctgacgccgcgctccagatcgatcgcatctacaccaagaaacagcatatcgaagtggtaattttgcagcgattgctcagcctgatcgccgtaaaaagattgcgactgacggcgcaaatgcccgccggtcatcagcagctcaacgccttccgcttccagcaacgcattagccacgttcataccgttggtcatcgcaattacgtcagtgtgcttgcgcatcagacgagcaatctcaaaagtggtggtcccggaatcgaggataacccgatgacctggctgaatcaactcaacggcagctttcgcaacgctgcgtttcatcgcggtgttcagtgcgcttttatcttccactgatggctcgactgacggcgtcgtgctatcgcagatcaacgcgccaccataggcacgcacagcgatcccctgcttttccagaaacgccagatcgttgcggatcgtcacagtagatacgccatacaatgccgacagatcgttaacctgcacactcccttgctgtcgcagacgctgaatgatctgttctcgtcgctcgctggtgccagtcactcgcttctcacctgaagcgtcggtattactcatagtaagtcctttcgtaaaactttcgtttcatttcgttttgcctattaacgcctttctattaagcaaatgcaagcccaccttgcccattgacgcaagctactctcgtttcagtgactttcattatgtttcttttgtgaatcagatcagaaaaccattatctttcgttttatttttatctcaccatgacgcagtatcaactgaaacaaaacgaaagattaatatcgcagtaatctgaactggagaggaaagtgaaacatctgacagaaatggtgagacagcacaaagcgggcaaaacaaatggaatttatgccgtttgttccgcacatccgctggtgctggaagctgcaatccgctacgccagtgcaaaccaaacgccgttactgattgaagcaacctccaatcaggtagaccagttcggcggttataccggaatgacgcccgccgattttcgcggctttgtttgtcagctcgccgactcgttgaatttcccgcaggatgcgttgattctgggtggtgaccatctggggccaaaccgctggcaaaacctgccggccgctcaggcaatggccaatgccgatgatttgattaaaagctacgttgcggcaggattcaaaaaaatccaccttgattgcagcatgtcctgtcaggacgatccgattcccttaactgatgacatcgtggctgaacgcgccgcccgtctggcgaaagtggcggaagaaacctgtcttgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcaaggtttgaatgccatctggccacgcatcattgccctggtggttcaacccggcgtcgaattcgatcacaccaacgttattgattatcagcccgccaaagcgagcgccttaagccagatggtcgaaaactacgaaacgctgattttcgaagcgcactctaccgattatcaaacgccgcaatcgctgcgccagctggtgattgaccactttgccattctgaaagttggcccagcgctgaccttcgccctgcgtgaagctctgttctctctggcggcgattgaagaagaactggtgccagcgaaagcctgttctggtctgcgtcaggtgctggaagacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggtacgtaatctggcggattcaccaattccgctgccgctgatcagccagtatctgccgctgcagtacgtgaaagttcgctccggcgagctgcagccaacgccacgggaactcattatcaaccatattcaggacatcctggcgcagtaccacacagcctgtgaaggccaataagcaaaacaaagaggaacacgctatgccaaatattgttttaagccggattgatgaacgcttgattcacggtcaggtcggcgttcaatgggtcggatttgcgggggcaaatctggtgctggtagccaacgatgaggttgccgaagatccggtacaacaaaacctgatggaaatggtactggcagaagggatcgccgtacgtttctggacgctgcaaaaagttatcgacaacattcatcgcgccgccgatcgacagaaaatcctgctggtttgtaaaacacccgccgatttcctgacgctggtgaaaggtggcgttccggtgaatcgcattaacgttggcaatatgcactacgccaatggcaaacaacaaatcgccaaaacggtttctgtggatgcgggcgatatcgcagcatttaacgacctgaaaaccgctggggtggaatgcttcgttcagggcgtcccgacagagcctgctgtggacctctttaaattactttgagggattcatcatggaaatcagcctgttgcaggcatttgcgttgggcattatcgcctttatcgctggcctggatatgtttaacggcctaacccatatgcaccgcccggtggtcctcggcccgttggtcgggctggtacttggcgatctgcataccggaattttaaccggcggtacgctggaactggtgtggatggggctggccccgctggcgggcgcacagccgcctaacgtgattatcggtactatcgtcggcacggcgtttgccattactactggcgtgaaacccgatgtcgcagtaggtgtcgccgtacctttcgctgtcgcagtacagatggggattaccttcctgttctcggtgatgtccggcgtgatgtctcgctgcgacctggcaacaaacccgcgccgcatttgatgctggtgccgacggcctggtgcattgctataacgggatgacaggtttacatcaccgcgaaccgggaatggttggcgcgggattaacggacaagcgcgcctggctggaactgatagccgatggtcatcatgtgcatccggcggcaatgtcgctgtgttgttgctgtgcgaaagagagaatcgtactgatcaccgacgcgatgcaggcagctgggatgccggatggtcgctatacgttatgtggtgaagaagtgcagatgcacggtggcgttgtccgtaccgcgtctggtgggctggcgggcagtacgctgtctgttgatgcggcagtgcgcaatatggtcgagttgacgggcgtaacgcctgcggaagccatccatatggcgtcgctgcatccggcgcgaatgctgggtgttgatggtgttctgggatcgcttaaaccgggcaaacgcgccagcgtcgttgcgctggatagcgggctacatgtgcaacaaatctggattcagggtcaattagcttcgttttgatagtttgctcctttattgggccttcacttcccccgtaaggcctttctttttctttcgttttgatctgtgcagcggtgtcggatgcgacgctaacgcgtcttatccgacctacagttggtgaccgcaaggccggataaagcgtttgcgccgcatccagcaatcccttttgcttcctttatcttttctttcaacgatcacaaatttcgttttatttcttttttctccattgaactttcagtttcttttctatagattttaatcaacgaaagacatcaccaagtgaaatgaaacgaaaggcaagtgaaagcgacaacgcccgacgtcaagttcatcagactaaggattgagttatgccagaaaattacacccctgctgccgccgcaaccggtacatggactgaagaagagatccgccatcagcctcgcgcatggatccgttcactcaccaacatcgacgcgctacgttccgcgctcaataacttccttgaaccgttactgcgcaaagagaatctgcggatcatcctgaccggagccggaacgtcggcatttatcggtgacatcatcgcgccgtggctcgccagccataccggtaaaaacttcagcgccgtaccgaccaccgatctggtcaccaatccgatggactacctgaacccagctcatccgctgctgttgatctccttcggtcgatccggcaacagcccggaaagcgtcgcagccgtggaactggcaaatcaatttgtaccggaatgctatcacctgccgatcacctgcaacgaagcgggcgctctttaccaaaacgcgatcaacagcgataacgcgtttgccctgctgatgcccgcagaaacgcacgatcgcggctttgcgatgaccagcagcattaccaccatgatggccagctgcctcgcggttttcgcacctgagacgatcaacagccaaaccttccgcgacgtggcggatcgttgccaggcgatcctgacctcactgggcgatttcagcgaaggtgtgtttggttacgcaccgtggaaacggatcgtttatctcggtagcggtggcttacagggcgcagcacgcgagtcggcgctgaaagtgctggaactgacggcgggtaaactggcggccttttatgattctccaaccggattccgtcatggaccaaaatcgctggtcgatgacgaaacgctggtggtggtatttgtctccagccacccttacacccgtcagtatgatcttgatctgctggctgaacttcgccgtgacaaccaggcaatgcgtgtaatcgccatcgccgcggaaagcagcgacatcgtcgctgccggtccacatatcatcctgccaccgtcacgtcactttatcgacgttgagcaggcattttgcttcctgatgtacgcccagacgtttgcactgatgcagtcgctgcacatgggcaatacgccggataccccatcagccagtggcaccgttaaccgcgtggtgcaaggcgtaatcattcatccgtggcaggcataagaggatcgcattatgagcattatctccactaaatatctgttacaggacgcccaggccaatggctacgcggtgcctgcttttaacattcataacgccgagacgatccaagcgatcctcgaagtgtgcagtgaaatgcgatcgccggtgatcctcgccggaacgccggggacctttaaacacatcgcgctggaagagatctacgccctgtgtagcgcctattccacaacctacaacatgccactggcgctgcatctcgaccaccacgaatcgctggatgatattcgccgtaaagtccacgcaggtgtgcgcagtgcgatgatcgacggcagccacttcccgtttgccgagaacgtgaagctggtgaaatcggttgttgacttctgccactcacaagattgcagcgtggaagcagaactgggccgcctgggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtggatgttcctctggtgctgcatggtgccagcgatgttccggatgaatttgtccgtcgcactattgaacttggcgtcacaaaagtgaacgttgccacagaattaaaaatagccttcgctggcgcggttaaagcctggtttgcggaaaatccgcagggtaatgatcctcgttattatatgcgcgtcggaatggatgcgatgaaagaagttgtcagaaataaaattaatgtctgtggttcagcgaatcgaatttcagcataatcattagttttttatgatttatcccaatgtacttcccgattaatatcggggagtgccttaatggaaaaggagataactaaaccttaataaatacatcactacaatatcgcaacaataatatatttaaaaaaattatattattcaactttatggtgaggattacacaatgaccagtccaaatattctcttaacccgtattgataaccgtctggttcacggtcaggttggcgtgacctggacatccaccatcggtgcaaatctgctggtagtcgtggatgatgttgtcgctaacgatgatattcaacagaaattaatgggtattaccgcggaaacctacggctttggcattcgtttctttactatcgaaaaaaccattaacgtcatcggcaaagctgcaccacatcagaagatcttcctgatttgccgtacgccacaaacggtacgtaaattggtagaaggtggtattgacctgaaagatgtcaacgtcggcaatatgcatttctcggaagggaaaaagcaaatcagcagtaaagtttatgtcgatgaccaggatctcacggacttacgttttattaaacaacgtggcgtgaatgttttcattcaggacgtccctggcgatcaaaaagaacaaatccctgactaaatctaaaatcgccttaatattggtttgaggtaataaaaatgcatgaaataaccctacttcagggattatccctggcggcgttagtttttgttctggggattgatttttggctggaagccttatttttattccgcccgataatcgtttgtaccctaactggcgctattctcggtgatattcagactggcttaattaccggtggtctgacagagttggctttcgccggattaacccctgcaggtggtgttcagccgcccaacccgattatggcgggtctgatgaccaccgtcattgcatggtctacgggcgttgatgccaaaacagcaattggtcttggcctgccgtttagtttgttaatgcagtacgtcattctgttcttctattccgctttctcattatttatgaccaaagccgataaatgcgcgaaagaggcggatacggcagcgttttcccggcttaactggacaacgatgctcatcgtcgcttcagcgtatgcggtgattgctttcctctgtacttacctggcacagggggcgatgcaggcgctggtgaaagcgatgcccgcctggctgacccacggctttgaagtggctggcggtattctgcctgccgttggttttggcttgctgctgcgcgtaatgttcaaagcgcaatatatcccttacctgatcgccggtttcctgtttgtttgctacatccaggtcagcaacctgttgccggttgccgtactgggcgcaggctttgcggtgtatgagtttttcaatgcgaaatcccggcagcaagcgcaaccgcagcccgttgccagtaaaaatgaagaagaggactacagcaatgggatctgaaatcagtaaaaaagatatcacccgtctgggctttcgttcgtcgctgctgcaagcgagctttaactacgaaaggatgcaggcgggcggttttacctgggcgatgttgccgatcctgaaaaagatttataaggacgacaaaccgggcttaagcgcggcgatgaaagataacctcgaatttattaatacccacccgaatctggtcggattcctgatggggttattaatttcgatggaagaaaaaggagaaaaccgcgacaccattaaaggcctcaaagtggcactgtttggcccaatcgccgggattggcgatgcgattttctggtttactttgttgccgattatggcgggaatttgctcatcatttgccagccagggaaacctgctggggccgattctatttttcgccgtttacctgcttatctttttcctgcgcgtcggctggacccacgtcggttattcagtcggcgtgaaggcgatcgataaagtgcgagagaactcgcagatgattgcccgttcggcaaccatcctcgggatcacggtaatcggcgggctgatcgcttcgtatgtgcatattaacgtggtgacatcgtttgccatcgacaatacccacagcgttgcgctgcagcaggatttcttcgataaagtcttcccgaacattttaccgatggcctacaccctgctgatgtattacttcctgcgggtgaaaaaagcgcatccggtgctgttaatcggcgtgacttttgtgctctctattgtttgttccgcattcggcattttgtaaatggaacgaggcactgcgtctggtggtgcctctttacttaaggaatttcatcctgtgcaaacccttcagcaagttgaaaactatacggcgttaagtgaacgtgccagcgaatatttattggccgtgatccgtagcaaaccgaatgccgtgatttgcctggcgaccggagccacgccattactgacgtatcattatctggtagaaaaaatccaccagcagcaggttgatgtcagccagctcaccttcgtgaagctcgacgaatgggtggatctgccattaacgatgccaggcacctgcgaaactttcctgcaacagcatatcgtgcagccgctggggctacgtgaagaccagctcatcagctttcgctccgaagagataaatgagacagagtgcgaacgggtaacgaacctgattgcgcgcaaaggcggtctggatttatgcgttctcggattggggaaaaacggtcatcttgggctgaacgaaccgggagaaagcctgcaaccggcctgccatatcagtcaacttgatgccagaacacagcaacatgagatgttaaaaaccgcgggtcgccccgtgactcgtgggatcaccttaggcctgaaggatattctcaatgcccgcgaagttttgttactggtgactggcgaaggaaagcaggatgcgacagatcgttttctcacggctaaagtctctaccgctatcccggcttcatttttatggctgcacagtaactttatttgtttaattaacacctaaccagatgaaaaatttgctcaaaatgtttaaattaacttatgtaacagtcacgcattatattaaataacatttgactgggttgaacataacgccgatagcaaaaggagttatgttcaacaatttaattttagatatacatataacttgttctattaataaatcacctcgtattctgactcgccccctggcgcagcaaagtcaggcatttatactcttttgaatacatagaaaattgatatcaatataatgaaaatatcaaatatttgcatataaatataatcttaaagttcagtctatttaatgttcaatgaaatatttctgcctgtataatctttaaagatgttgaacatatattcacattaaatatgattatgtacttgttacaaggataaggttatatatgaataaagttacaaaaacagctattgcgggcttacttgcgcttttcgcaggtaatgccgctgcaaccgatggtgaaatagtttttgatggcgagattttaaaatccgcttgtgaaatcaatgactctgataagaaaattgaagttgctcttggtcactataatgccgaacagtttcgtaatattggcgagcgtagcccaaaaattccattcactattcctttagttaactgcccaatgactgggtgggagcacgataacggcaacgttgaagcgtctttccgtctatggctggaaacgcgagataatggcaccgtccctaacttccctaatctggcaaaagtaggctcttttgctggcatagcggcaacaggtgtgggtatccgtattgacgatgcggaaagcggaaacattatgccactgaatgctatgggcaatgataacacggtttatcagatcccggcggaatccaatggtattgtcaatgttgacctcatcgcttactacgtatcaaccgtagttccatcagaaatcaccccaggggaagcagacgctatcgttaacgtaacgctggattaccgttaatacgttagggcgttatctgacctgtcagataacgcccttttccttcctctttctcgttgtatcaggttgaaaaataactatgtcaaaacgaacattcgcggtgatattaaccttgttgtgtagcttctgtattggccaggcgcttgcaggaggaatcgttttacagcgaacgcgagtgatctatgatgccagccgcaaagaggctgcgttacctgtcgcaaacaaaggcgcagaaacgccttatttactgcaatcatgggtagataatatagatggtaaaagccgtgccccatttattataaccccaccgctatttcgtcttgaggctggcgatgactcatcactgcgaattattaaaacagctgataacctgcctgaaaataaagagtcgctgttctacattaatgttcgtgccattccagcaaagaaaaaatcagatgatgttaatgctaacgagttgacgctggtatttaaaacacggatcaaaatgttttatcgccccgcacacctgaagggacgggtaaacgatgcgtggaaatcactggaatttaaacgtagtgaccattcactcaatatatataacccaactgaatattacgtcgtatttgccggactggcagtcgataaaaccgatctcacaagcaaaattgaatatatcgcgcccggagaacataaacagttaccacttcctgcatctggcggaaagaacgtgaaatgggctgcgatcaatgattatggcggcagttccgggacagaaactcgtccactgcaataaaaaatataaaaacacaggtcatcagggaatgccacaacgacaccaccagggacataaacgcacaccgaaacagttggcgctcatcatcaaacgttgtttgccgatggtgctcactggcagcggcatgctttgcactaccgctaacgccgaagagtattatttcgaccccattatgctggaaaccacaaaaagtggtatgcaaacaaccgatctgtcgcgtttttcaaaaaaatatgcacaactaccaggaacttatcaggttgatatctggctgaataaaaagaaggtttcacagaaaaaaattacatttaccgccaatgcagagcaacttctgcagccacagtttacggtagaacaactacgtgagctgggtattaaggtggatgaaatcccggcgctggctgaaaaagatgacgatagcgtgatcaactcgcttgaacaaatcattcccggtacagctgctgaatttgatttcaatcatcagcaacttaatttgagcattccccaaattgcactgtaccgtgatgcaagaggttacgtctccccttctcgttgggacgatggtataccaacgctgtttaccaactactcgtttacaggttctgataaccgttaccgccagggcaatcgtagccaacgacagtacctgaatatgcaaaatggtgctaattttggcccctggcgattacgcaactattccacatggacacgcaacgatcagacatcaagctggaataccatcagtagttatttacaacgtgatatcaaggcgttgaagtctcagttgcttctgggagaaagcgccaccagcggcagtattttttccagctacacctttactggcgtgcaactcgcttccgacgataatatgttgccaaacagccagcgcggatttgccccaacggtacgcggtatcgcaaacagtagtgcaatcgtgactatcaggcaaaatggttatgtgatctatcaaagcaacgtgtcagcgggtgcctttgaaattaacgatctctacccctcttccaacagcggcgatttagaagtcacgattgaagaaagtgacggtacacaacgtcgctttatccagccttattcttcattacccatgatgcagcgacctgggcatctaaagtatagcgcgaccgctggacgctatcgcgctgatgcaaacagtgatagcaaggaacccgaatttgctgaagccacggcaatatatggtttgaataatacttttacgctgtatggcggcctgctcggttctgaagattattatgcgctggggatcggtatcggcggcacacttggcgcactgggcgcgttgtcgatggatatcaacagagctgacacccaattcgataaccagcactcttttcatggctatcaatggcgtacgcagtacatcaaagatatcccggaaaccaacaccaatatcgctgtcagctactatcgctataccaacgatggctattttagttttaatgaagccaatacccgcaattgggactataacagtcgccaaaaaagtgaaattcaattcaacatcagccagacaatatttgatggggtaagtctgtatgcctccggttcgcagcaagactattggggcaataacgataaaaacaggaatatctctgttggggtttccggccagcaatggggagttggttacagcctgaattatcaatacagccgctacactgatcaaaataatgaccgcgcactctctttgaatctcagtattccgttagaacgctggttaccgcgtagccgggtttcctatcagatgaccagccagaaagatcgcccaacccaacatgaaatgcgtcttgatggctcactgctggatgatggtcgcctgagctatagcctggaacaaagtctggatgacgataacaaccataacagtagcctgaacgccagttaccgttcaccttatggcaccttcagtgccggatacagctacggtaatgacagcagccaatacaattacggcgttaccggcggcgtggttatccatcctcatggcgtgacgctctcgcaatatctgggcaacgcttttgcgcttatcgatgctaacggagcatctggcgtgaggatacaaaactatccggggattgctaccgatccttttggctatgcagtggttccttatctcacaacttatcaggaaaaccgtctctcggtagatactacgcagctgcccgataacgtcgatcttgaacaaacaacacagtttgtggtgcccaacagaggtgcaatggtagcggcgcgtttcaacgccaatatcggttatcgcgtacttgttacagtcagcgatcgcaacggtaaaccgttgccctttggcgctcttgccagcaacgatgatacggggcaacaaagtatcgtcgatgagggcggcatactatatctctctgggatatcgagtaaatcacaaagctggactgtacgctggggaaatcaggcagatcaacaatgtcagtttgctttcagtacaccggattcagaacctacaacctctgtattacaaggcacagcgcagtgccattaaggataaaaaaatgaaaagagcgcctcttataacaggtcttttgttgatatccacatcctgcgcttatgcctcctcaggagggtgtggagccgacagcactagcggtgcgacaaattacagcagtgtggttgatgatgttacggtgaaccagacagataacgtgacaggacgggagtttacctctgcaacgctaagtagcactaactggcaatacgcctgttcctgctctgcgggtaaggcagttaaacttgtctatatggtcagccccgtacttaccaccactggacatcagacaggatattacaaactcaatgacagcctggatattaaaaccacattacaggcaaacgacattccaggactcacaaccgaccaggttgtctctgttaacacccgattcacacagataaaaaacaacacggtatattctgctgcaacccaaacgggtgtttgccagggtgatacgtctcgttatggacccgttaatattggtgcgaacaccacctttaccctgtatgtcaccaagccatttctcggctcgatgaccattccgaaaacggatattgccgtcattaaaggcgcgtgggtcgatggaatgggaagcccgtctacaggtgacttccatgatttagtcaagttatcgattcagggaaatctcaccgccccacagtcgtgcaaaattaatcagggcgatgttattaaggttaattttggattcatcaatggtcagaagtttaccacccgcaatgccatgccagacggttttactccagtagactttgatatcacttatgactgtggtgatacttcaaagattaaaaactcgttgcaaatgcgcatcgacggtacaactggggtagtagaccagtacaacctggtcgccaggcgaagaagttcagacaatgtgcccgatgtcggtattcgtattgaaaatctcggcggcggagttgcaaatattccttttcagaacggtatccttcccgttgatccttccgggcatggcaccgtcaatatgcgcgcctggccagttaatctggtcggtggtgagctggaaacaggaaaatttcagggcacagccaccattaccgtcatcgtgcggtaaaagaagacgttgcgttttgattaacgcaacgcttcggcactgttacccctgctgctccagcgcatacttatacagcgcatttttcttcacgccgtgaatttctgcggccagcgccgccgcttttttcagcggcagttctgcctgtagcagcgccagcgtgcgcagggcatcggcgggtaagtcttcttcctgtgctttatgaccttcgacaatcagcaccatttcgcctttgcgacggttttcatcttcctttacccacgccagcagctcgccaacgggcgcgccgtgaatggtttcccaggttttggtcagctcacgcgccagaaccacgtagcgggattcgcctaataccgcaacgatatcttccaggctatctaacagacggtgggtagattcataaaaaatcagcgtgcgcggctccgcttcaatggcttttagcgcatcacggcggccttttgatttggcaggtaaaaagccttcgtaacagaaacggtcagagggtaaacccgctgcgcttaacgcagtgatagcagcacacggcccgggtagcggcaccacgcggatccccgcttcacggcaggtacgcaccagatggtagccaggatcgttaattagcggcgttccggcatcggaaaccagcgcaatgttttgcccctcttgcagcttcgccagcagcgtttcagctttttgttgttcgttatggtcgtgcagcgcaaacaaccgggcattaatcccaaaatgttgcagcaataaaccggtgtgacgagtatcctcggcggcaatcagatcaacggcctgtaatacctctaacgcacgctgggtgatatccgccagattgccgattggcgtcggtacaatgtaaagctggccctgagaattatccgccgattggtgttgtttcattgtgtcgtccgtattgccgatttaatattgagcattgcgtaaaaaaaatatcactggatacattatggtaccctcaacattttctcgtttgaaagccgcgcgttgtctgcctgttgttctggcagccctgattttcgccggttgtggcacccatactcccgatcagtccactgcttatatgcagggcacggcgcaggctgattctgccttttatcttcagcagatgcagcaaagctctgatgataccaggatcaactggcaattactcgccattcgtgcactggtgaaagaaggtaaaaccgggcaggcggttgagttgtttaaccaactaccgcaagaactgaacgatgctcagcgtcgcgagaaaacactgctggcggtagagattaaactggcgcagaaagattttgctggcgcgcaaaacttgctggcgaaaatcacacctgccgatttagaacaaaaccagcaagcgcgttactggcaggcaaaaatcgatgccagccaggggcgtccttccattgatttactgcgcgcgttaattgctcaggaaccgctgcttggcgcgaaagaaaaacagcagaatattgatgccacctggcaggcgctctcctccatgactcaggaacaggcgaatacgctggtgatcaacgccgacgaaaatattctgcaaggctggctggatctgcagcgcgtctggtttgataaccgtaacgatcccgacatgatgaaagccgggatcgccgactggcagaaacgttatccgaacaatccgggcgcgaaaatgctgccaacgcagttggttaacgtaaaagcgtttaaaccagcctcgaccaacaaaatcgccctgctgttgccactgaatggccaggcagcggtatttggtcgcactattcagcaaggctttgaagcggcgaaaaatatcggcactcagccagtggcagctcaggtagctgccgcacctgccgcagacgtagctgaacaacctcagccgcaaaccgtggatggcgttgccagcccggcacaagcctcggttagcgatctgaccggtgaacagcctgcagcccagccggtgcctgtaagcgccccggcgacaagcaccgcagcggtaagcgcacccgcaaatccatccgcagagctgaaaatctacgatacctcatcacaaccacttagccagatcttaagccaggttcagcaggatggcgcgagtattgtggtcggtccgttgctgaaaaataacgttgaagagttgctgaagagcaacactccgctgaacgtactggcactgaaccagccggagaatatcgaaaatcgcgtcaatatttgttacttcgcgctttcaccggaagacgaagcgcgcgatgcagcgcgtcatattcgtgaccagggtaaacaagcgccgctggtgctgatcccacgcagttcattgggcgatcgcgtagccaatgcgtttgcgcaagagtggcagaaactgggcggcggcaccgttctgcaacaaaaatttggttccaccagcgaattacgcgcgggtgttaacggcggttctggtattgctttaacgggtagcccgattactctcagagcgacaaccgactccggcatgacgaccaacaatccaacgctgcaaaccacgccaaccgatgaccagttcaccaataatggcggtcgtgtcgatgcggtgtacattgtggcaacgccgggtgaaatcgcttttatcaaaccgatgatcgccatgcgtaacggtagccagagcggtgcaacgctgtacgccagctcccgcagtgcgcaagggaccgctggcccggatttccgactggagatggaaggcttgcagtacagcgaaatcccgatgctggcaggcggtaatctaccgttaatgcagcaggcactcagcgcggtgaataacgattattcactggctcgcatgtatgcgatgggcgtcgatgcctggtcgctggcaaatcatttctcacaaatgcgccaggttcagggttttgaaatcaacggtaataccggaagcctgacggctaacccggattgcgtgattaacaggaacttatcatggctacagtaccaacaaggtcaggtagtccccgtcagttaaccaccaaacagaccggcgatgcgtgggaagcacaagcgcgtcgctggctggaaggcaaaggactgcggtttatcgccgctaacgtgaacgagcgtggcggcgagatcgatctgataatgcgtgaaggccggaccaccatttttgtcgaggtacgctatcgccgctctgcgctttatggcggcgcggcagccagtgtgacccgcagcaaacaacacaaattattacagactgcccgcttgtggctcgcgcgtcataatgggagttttgatactgtggattgccggttcgatgtggtagccttcaccgggaatgaggttgagtggattaaggatgcctttaatgaccactcataattaaggtttaaggattagcgtgcaagaaagaattaaagcttgcttcactgaaagcattcaaactcaaattgcggcggcagaggcgcttccggatgccatctcccgtgcagccatgacgctggttcagtctctgctcaatggcaacaaaatcctctgttgtggtaatggaacttccgctgccaatgcacagcattttgctgccagcatgatcaaccgtttcgaaacggagcggcccagcttacctgccattgcactaaatactgataatgttgtcttaacggcgattgccaacgatcgcttacatgatgaagtgtatgcaaaacaggtgcgggcgctgggtcatgcgggagatgtattgttagccatttccacccgtggcaacagccgcgatattgttaaagcagttgaagccgccgttacgcgtgatatgaccattgtggcattgaccggctatgacggcggcgaacttgcaggtttgttagggccacaggatgtggagatccgcattccttcgcatcgtagtgctcgcattcaggaaatgcatatgctgacggtaaattgcctgtgcgatctgatcgataacacgcttttccctcaccaggatgattaaggagaatacatgaaggcattatcgccaatcgcagtccttatttccgcgctgctgttgcaaggttgtgttgccgctgccgtagtgggtaccgctgctgtgggtaccaaagccgcaactgacccacgcagtgtcggcacccaggtggacgatggtaccctggaagtgcgcgtgaacagcgcattgtcgaaagacgaacagattaagaaagaagcgcgcattaatgtaacggcctatcagggcaaagtgctgctggttgggcagtcaccaaatgctgaactttcggctcgcgccaaacagattgctatgggcgtagacggtgccaacgaagtgtataacgagattcgtcagggccagccgattggtctgggcgaagcatctaacgatacgtggatcaccaccaaagtgcgttcgcagctcttaaccagcgacctggtgaaatcgtccaacgtgaaagtgaccaccgaaaacggtgaagtgttcctgatggggctggtgactgaacgtgaagcgaaagcggcggcagatattgccagccgggtgagcggcgtgaagcgggtaactacggcgtttacgtttattaaatagcagccccttgtaatgcctgatgcgacgcttgccgcgtcttatcaggcctacaacgatacaaaccgtaggtcagataaggcgtttacgccgcatccgacatgttttccctcaaatcagaacaacagcgccagcccgccgacaatcacaccagacactgccaccatcgcccctgtcagccataaggctttcgccgggaacgctttgcgcagcataatcagtgacggcaaactcactgccgggagcgtcatcaacaatgccagcgccggagcggttcccatacctgccagcatcatcgtttgtacaatcggaatttctgctgccgtgggaatgacaaacaagcatcctgctaccgccatcgccaccacccacatcaggctgttatcgacagcaccatcggcatgggggaataaccagacgcgagcggcacccaacaccagtactgcaaggatgtaaaccgggatcgtactccagaaaagcgtccatagcgccctgccccagcggctaaaaaacccgccctgtgcttccggtatgtcaatttcgaccggtgcctgcgtttgcggtgtttcacgcacccatttttgcaccagcgtcgcaatcagcaacaccatcaccagcccggccaccagacgaatcgccgcaaaaccccagccgaggacaaagcccataaacaccagcgtcgccgggtttaacaccggattgcccatccagaatgccagcgcaccgcccatcgacacctgttggcgacgcattcccgccgcgaccggagccgcacagcaggtacacatcatgcccggcaacgaaaacagcgttcccagcagcgtgccgcgaaagcgcgattgcccaagcgtacgcaacaaccagtcacgcgggatcagcacctgaatcaacgaaccgaggatcacccccagcaccgccgctttccataccgcgaggaaatagatcatcgcgtaatccaacgccgcctgccatgggttagcatccgcctgcgcaaggatagatttaccgatactgtgggtttcggcagcagtaaacgctttgccgtagtaaggttcccatttcacataccagagaccggcaatgacaacgagaaagaaaagcgcgggtttccaccactgaatgggcgttgccgcctgagatgaagactgaccagtcatagcattccccaggaataagttatgataattgagcgcgtgaatattacgctcactatcaattcttgggaataattattcagctcttttgcgtaattctgaagagcttaaaatcgtcacgccttcatgctcaggccgcatcgactctgccagcatgacccgcgccacgtctctcgcatcaatggatttccagttacctggtaacaaacggaacagcggcgcaaaaagcgtttcgttcatccgctgtttgctacgatcgcccagtaacatcgacgggcgagcaatggtcaatttcggccagttctgggcgattaatgcttcttccatctcccctttgacgcggttatagaaaaacggcgagtgggcattggcacccatcgcactgactaccaacatatgctgcgcgcccagtcgccgcccggttaatgcggtatccactaccagcgtgtaatcggcatgaataaacgcctctttgctccccgcttctcgccgcgtggtgccgagacaacaaaacacaatgtcgatgggatcggtgacctgcgccaacgcgtcactcagttgcggatcatggggattaaacaccccgggcatatcgcccaacggacgtcgcgtcggcgcagcaatggcgttaactttcggttcgttaatcaacatccgcagcaggtgaccgcccaccagccccgttgcgcctgtaatcagtacctgactcatcttcgctcctttacagaattgtctgccttgcgctccacggctcatgcaccaggcttaatagaccatgaggtaattatccccgattgtgggaaattcgcctcatccaatgcaacaacgcggaggaagcatgagtaagaaaattgccgttttaatcactgatgaatttgaggattcagaatttacttcacccgcagacgagttccgtaaagccggacacgaagtgattaccattgaaaaacaagcgggtaaaacggtgaaaggcaaaaaaggagaagccagcgtgaccatcgataaatccatcgatgaagtgacgcctgcggagtttgatgccctgctgctaccgggcggccattcaccggattatctgcgtggggacaaccgttttgtcacctttacccgtgattttgtgaatagtggcaaaccggtgtttgccatctgtcacggcccgcagttgctgatcagcgccgatgtgattcgggggcgcaaactgaccgcagttaaaccgatcattattgatgttaaaaatgcgggcgcggaattttacgatcaggaagtcgtggttgataaagatcagctggttaccagccggacaccggacgatctgccagcgtttaaccgcgaggcgttacgcctgctcggtgcctgagtcgcgtagccaaatcatttttttaccaaagcccagcgtgttgtcggtgaatttgatttcatcgagccggatttcccacaccggggccgacagcattctggcaaccggaaagcgacgattgtacgccttgcgcgcgaggtcgctttcctcaccttccagcctgcggatctcacctttaaactgcacaccgcgaattaacgctaccgttttcggctgaccgtttaccgttccggcaaccgcagcctgcggcccactcatctgcgcgtggcgcgttttttcttccgtcaaaatgtagaaggcgactttctgcgcatcaaaaagataaaaggcattagcgcaccagagttccccttcctgctgcacacaccaagtgacaacatgttgttttgccagccaacggctgatggcgatgagtgtttccattgctgttctcttttatactgtgggcctgaccttaacatgcgacgcagacgatgacaccctggtttctttacttgatccgtaccgccgacaataagctttataccgggatcaccacggatgtcgaacgccgctatcagcagcaccaaagcggcaaaggggcgaaagcactgcgcgggaaaggagaactaacgctggtgttttccgcgccagtgggcgatcgttcgctggcgttacgggcggaatatcgcgttaagcaactgaccaaacggcaaaaagagcgtctggtagcggaaggcgcagggtttgcagagctgttaagcagtctgcaaaccccggagattaaaagcgattgaaatgctcgtgatactcaaccaggccggtaacgccattcagcgcgtcatccgctaaacgatgtacctggaaggcgctttcagtgcccggccagcggcaacgcagatcgtgatgcgccgccagttcaaagccgaaacgactgtacagcgccggatcgcccagcgtcaccactgcggcatagccgaactcattaagcgaatcgagtccttcatagaccagttggcgtgccagcccctgtccacggtatttttcatcaaccgccaacggtgccatgccgacccattgcaggtcttcgccctgcacatcaaccggactaaatgccacatagccaatgacctgaccttcgtcatctgtcgccaccagccccagcgtcagaaagccatcttcacgcagatcgtgaaccagcttcgcttccgcatcactttcgaatgagcgacgcagcagggcatcaatacccggcgcatcaatgggaatttctactcgaattagcatggttcacctaccgatgtctgtttggtttcaggcgcggttttcattcccgcctcaacaaaatccgccagttgcagcagcatcatgcgtaaggctttcggcatttgctccagttcaatggcgtccatcaggtttttcacatacagccccagctccgtatcgccttcaatcaccagccgacgctggaagaagagcgtatccggatcttgtttacgcgccgcaatcatcagcagatcgctggcgtcggcactaaaactcacatcagcttgcgcgttctggctaacgaccagtttgccattcaccaccgaggtaaaccattgcaggtcaatatcacgcacatgaatacttaaccagcggccttcaagaaactccagctcgccatcatccagcgcctggcggaattgccagcttaagacctgctcaagaacctggcgttttagcgcaaatggcgtcagttttaccggtacactcaacagagatggccccaaatgcacaatacgggaacgcagtttatccaacacgagttttactccctgtttcaacaatcatcctattttgccatatcagaaaaataacatagcggtataaatcaacaattccatatgaaattgctgctaccaccaatacaactttaactgccttaaatcaaaaattgtcgcagcaaggttaactaaaatcccagttcgttaacatttttgcgttttgatagcgcaaccttcaggaaaaattatggagctgctctgccctgccggaaatctcccggcgcttaaggcggccatcgaaaacggcgcagatgctgtttatatcgggctaaaagatgataccaatgcccgtcacttcgccggccttaactttaccgagaaaaaattgcaggaagcggtgagttttgtccatcaacatcgccgcaaacttcacatcgcgattaacacttttgcgcatccggacggttacgcccgttggcagcgcgccgtggatatggcggcgcagctgggtgccgacgcgctgatcctcgccgacctcgccatgctggagtacgccgccgagcgttatccgcatattgagcgccacgtatcggtgcaggcttcggcgaccaatgaagaggcgattaacttttatcatcgccattttgacgttgctcgcgtggtgctgccgcgcgtgttgtcgattcatcaggtgaaacaactggcacgggtcacacctgtaccactggaagtctttgctttcggcagcctgtgcattatgtcggaaggtcgttgctatctgtcgtcgtatctgacgggtgagtcgcccaacaccataggcgcgtgttctccggcccgtttcgtgcgctggcaacaaacgccgcaggggctggaatcccgcctgaacgaagtgctgatcgaccgttatcaggacggcgaaaacgcaggttatccgacgctatgtaaagggcgttatctggtggacggcgagcgctatcacgcgctggaagaaccaaccagtctcaataccctggaactgctgccggagttaatggcggcgaatattgcttcggtgaaaattgaaggccgccagcgtagcccggcgtatgtcagccaggtggcgaaagtctggcgtcaggctatcgaccgttgtaaggccgatccgcaaaactttgtaccgcaaagcgcgtggatggagacgctcgggtcgatgtccgaaggcacgcaaaccactcttggcgcatatcaccgtaaatggcagtgagaaaagcaatgaaatattccttagggccagtgctgtggtactggccaaaagagacgctggaagaattttatcagcaggccgccaccagcagcgccgacgtgatttatcttggtgaagcggtatgcagcaagcgtcgggcaaccaaagttggcgactggctggagatggcaaaatcgctcgccgggagtggtaagcagattgtgctctccacgctggcgctggtgcaggcatcatctgaactgggcgaactgaaacgctatgttgagaacggtgagtttctgattgaagccagcgatctcggcgtggtgaatatgtgcgctgaacgcaaactgccgttcgtcgccgggcacgcgctgaactgctacaacgcggtgacactgaaaatattgctcaaacagggcatgatgcgctggtgtatgccagtggagctttcccgcgactggctggtgaatctgcttaatcagtgcgatgagctgggcattcgtaaccagtttgaagtggaagtcctgagctacggtcatctgccgctggcctactccgcccgctgctttaccgcgcgttcggaagaccgcccgaaagatgagtgtgaaacctgctgcattaagtatccgaacgggcgcaacgtgctgtcgcaggaaaaccaacaagtgtttgtactcaatggcattcagaccatgagcggctacgtttacaacctcggtaacgagctggcatccatgcagggcctggttgatgtggtccgcctgtcaccgcagggtactgacactttcgcgatgctcgacgccttccgcgctaatgaaaatggcgctgcaccactgccgttgacggcgaacagcgactgtaacggctactggcggcggctggcaggactggagctgcaagcctaagtaaatagctcactttgttaacaactttaactactctttaatgcagtattaaagattaatcggtaacaaagtgagctgttatgactgataaaaccattgcgttttcgctactcgatctggcccccattcccgaaggttcttcagcgcgagaagcattctcccactctctcgatctcgcccgtctggctgaaaagcgcggctatcatcgctactggctggcagaacaccacaatatgactggcattgccagtgctgccacgtcggtattgatcggctatctggcggcgaataccaccacgctgcatctggggtctggcggcgtgatgttgcctaaccactcaccgttggtcattgcagaacagttcggcacgcttaatacactctatccggggcgaatcgatttggggctgggtcgtgctccgggtagtgaccaacggacaatgatggcgctacgtcgtcatatgagcggcgatattgataatttcccccgcgatgtggcggagctggtggactggtttgacgcccgcgatcccaatccgcatgtgcgcccggtaccaggctatggcgagaaaatccccgtgtggttgttaggctccagcctttacagcgcgcaactggcggcgcagcttggtctgccgtttgcgtttgcctcacacttcgcgccggatatgctgttccaggcgctgcatctttatcgcagcaacttcaaaccgtcagcacggctggaaaaaccatacgcgatggtgtgcatcaatattatcgccgccgacagcaaccgcgacgctgaatttctgtttacctcaatgcagcaagcctttgtgaagctgcgccgtggcgaaaccgggcaactgccgccgccgattcaaaatatggatcagttctggtcaccgtctgagcagtatggcgtgcagcaggcgctgagtatgtcgttggtaggtgataaagcgaaagtgcgtcatggcttgcagtcgatcctgcgcgaaaccgacgccgatgagattatggtcaacgggcagattttcgaccaccaggcgcggctgcattcgtttgagctggcgatggatgttaaggaagagttgttgggatagtgtgtcttaacgcgggaagccttatccgagctggcaacgctgtcctacatagacctgataagcgaagcgcatcaggcattgtgtaggcagcagaaatgtcggataaggcaccgctgattactgatacaccggcagtaaattaaagctcgataaaatatgcaccagtgcgttgccgacgccaaacaccagaatcagcgcaatcatcggcttgccaccccagacgcggaatttcgggctgccaaagcgtttacgcgatgcacgggctaacagcgccggaacaattgccgcccagatggtagccgctaaaccagcataaccaatggcgtacaggaatccgttcgggaacaacagcccccccacaactggcggggcaaaggtcagcaatgccgttttcaagcggcccacagccgagtcgtcgaaaccaaacagatctgccagatagtcaaacaaacccagcgttacgccgaggaacgaactcgctaccgcaaagtttgagaacacgaccagcagcagatccagactacggctgttcagtacgccgcttaacgcctgtaccagcacatcaatattaccgcccttctctgcaataccgataaactccggacgcgggatgttacccatcgtcgccagcaaccagatggtatacagcgccagcgccatcagcgtaccgtacaccagacatttcacgatggttttcggatctttgccgtaatacttcatcaggcttggcacgttaccgtgataaccaaacgatgccagacagaacggcagggtcatcaacagatacggtgcataagacgcattgctttcggcgacgttgaacaatgtcgcaggctgcacatgccccagcaggctaccaaaggtgaggaagaaggtaatgactttcgcccccagcacaatcgctgtcatgcgactgacggctttagtgctcaaccacaccacaaacgctaccagcaatgcaaaaccaaaacccgccgcccgtgccgggacgtttagtgacatctctgcgaaggtgtgatgcagaatcgaaccactggcagaaatataggcataggtcaggatatagagcacaaaggcaatggaaatgccgttgaccacgttccagcctttgcccagcaaatctttggtgatggtgtcaaaactcgaaccgattctgtaattcaggttagcttccagaatcatcaagccggaatgcagcatacagaaccaggtaaagatcagcgccgccattgaccagaaaaaccacgccccggacatgaccactggcagagaaaacatccctgcgccaataatggtgccgccgataatcaccacgccgccaagcagcgacggtgacgtttgggtggtggttagtgttgccatgagggcttctctccagtgaaaaatagtgcgactgcgttgttatgcattgcactgtaccagtacacgagtacaaaagacagaaaaaaagccccgatggtaaaaatcggggctgtatatattattttacagattgtgttcgctgttcagcgatgattacgcatcaccaccgaaacgacgacgaccggtagaatcatcacgacgcggagcgcggccttcacgacgttcgccgctaaaacgacgaccatcaccacggccaccttcacggcgttcaccgctgaagttacgaccgccttcacgacgttcgccaccgaaaccacgaccaccgccacgacgctcaccgccagtatgcggctgtgcatcgcccagtaactgcatgttcatcggcttgttgagaatgcgagtgcgcgtaaagtgttgcagcacttcacccggcatacctttcggcagttcgatggtggagtgagaagcaaacagcttgatgttaccaatgtaacggctgctgatgtcgccttcgttagcaatcgcaccaacgatatgacgaacttcaacaccatcatcgcggcccacttcaatgcggtacagctgcatatcgccaacatcacgacgttcacgacgcggacgatcttcacggtcaccacgcgggccacggtcgttacgatcgcgcggaccacggtcatcacggtcacggaattcacgtttcggacgcatcggcgcatctggcggtacgatcagagtacgttcaccctgtgccattttcagcagtgccgcagccagagtttcgagatccagctcttcaccttcagcagtcggctgaattttgctcagcagtgcgcggtattgatccagatcgctgctttccagctgctgctgtactttagcggcgaatttttccagacggcgtttgcctagcagttctgcgttcggcagttctacttccggaatagtcagcttcatagtacgttcaatgttgcgcagcagacgacgctcgcggttctcaacgaacagcagcgcgcggccagcacgacccgcacgaccggtacgaccgatacggtgaacgtaagactcagaatccatcgggatatcgtagttaactaccaggctgatacgctcaacgtccaggccacgggctgcaacgtcggtcgcaatcaggatgtccagacgaccatctttcaggcgttccagtgtctgttcacgcagcgcctggttcatgtcaccgttcagcgcggcgctgttgtagccgttacgctcaagagcttcagccacttccagagtcgcgtttttggtacgaacgaagataatcgccgcatcaaaatcttccgcttccaggaaacgtaccagtgcttcgtttttgcgcataccccagacagtccagtagctctggctgatgtcaggacgggtagtcacgctggactgaatgcgcacttcctgcggctctttcataaagcggcgggtaatgcgacgaatcgcttccggcatggttgcagagaacagagcggtctgatgaccttccgggatctgcgccataatggtttcaacgtcttcgatgaagcccatgcgcagcatttcgtcagcttcatccagaaccagaccgctcagtttagagaggtccagagtgccacgtttcaggtggtccagcagacggcccggagtaccgacaacgatctgcggcccctgacgcagggcgcgtaattgcacgtcataacgctggccgccgtacagagcaaccacatttacgccgcgcatgtgtttagagaaatccgtcattgcttcagcaacctgtaccgccagttcgcgggtcggtgccagcaccagaatctgtggtgctttcagctcaggatcaagattctgcaacagaggtaaagagaatgctgcagtttttccgctccccgtctgggccatacccagaacgtcgcggccattcagcagatgtggaatacactctgcctgaattggagatggtttttcgtaacccagatcgttaagggcttcaaggataggagccttcaggcccagatctgcaaaagtggtttcgaattcagccatgtagtacgtgtgcctcaaaattaatggcggccagtctacataactcatcatgaaattgatcagcaattttcattgaaaagtgtgaaccggctcaaagtaggtgtattaacgaacaacaacgccctcacccgttaaggtgatggcaatcaaaaaagattacgggctgatgtgtacgtcagctattgctggtccgattctgccaggtcatcttggtcctggcccaggagcgataattccaacaatgcgtatcggtgctcaacaaagttatgaacgttgttggcaaccgccagtttgaacagtgccgtggcgctgtccaaatcccccagacttaggtagtacttacctaaatagaagttggtttcactgagatgctcagcgagcgaggtgttatccgttgcgtccgccttgagcctttccattaacgtttgttcgctaatgttgcccaggtagaactcgacaatgttccatccccactgttccttatccgatttttcgaagtgctgtttcaacacttctttagcctgcttctcatcgagcttctgctcggcgagataaagccacagactacggaaaggatcattgggatcgtcttgataaaacgccagcagatcatcttgcgctaacttgtcacgaccgccgtaatataatgcgatcccgcgattcaagtgcgcgtagttgtaagttggatcaagctcaagtacagaatcaaacgcttcataggcagcatcaaaattgcctgcctgcgttaaatatatgcctaagtaattgaatacttcaggcatatccggtcggattgccagcgcttgcgaaaaatcgttacgcgctaatgccctcagaccgagactatcatacaacactccgcgctcatataaaagctgtgcgcgttcgtcatcggttaaagcccgactggcaaggatttgttccatacgtgccagaatcacttcctgctgtaaagtcggttgcaatggtaccgcgaggacttcacttttacgccaggaagtattactgcatcctgcaagcgtaagtgctgtcgcaacgaaacaccagcgcaaaaaaggcttcatttcccactcccgaagaccacggttgaatgaacgtcctgttcccggttgctaacaaggcgtcctgcccggttaaaagccccccgccgcagcggagggcaaatggcaaccttactcgccctgttcagcagccggagcttccggtgctgcagcaggttgagactgctcagtcgcttctttaatgctcagacggatacggccctggcgatcaacttccagaactttcaccggtacttcctgacccatctgcaggtaatcggtcactttctcaacgcgtttgtcagcgatttgagagatgtggaccagaccttctttaccgccgccgatggcaacaaatgcgccaaagtcaacgatacgggtcactttaccagtgtagacgcggcccacttcgatttctgcagtgatctcttcgatacgacgaatagcatgtttcgctttctcgccgtcggtcgctgcaatcttcacagtaccgtcatcttcgatttcgatggtggtgccagtttcttcggtcagagcacggattacagaaccgcctttaccgataacatctttgatcttgtccgggttgatcttgatggtatggatacgcggtgcgaactcagagatatcgccacgcggcgcgttgatcgcctgttccattacgcccaggatatgcagacgcgcacctttagcctggttcagcgcaacctgcatgatctctttggtgataccttcaattttgatatccatctgcagtgcagagataccgtcgcgggaacctgcaactttgaagtccatatcgcccaggtgatcttcgtcgcccaaaatgtcagacagtacaacgtagttgtcgccttctttcaccagacccattgcgatacccgcaacggcagctttgatcggcacacctgcgtccatcagcgccagagacgcgccgcacacggaagccatagaagaggaaccgttggattcagtgatttcagacacaacacgtacggtgtacgggaatttgtccatatccggcatgactgccagcacgccgcgcttcgccagacgaccgtgaccaatttcacgacgcttcggagaaccgaccatgccggtttcgcctacggagtacggagggaagttgtagtggaacaggaaggtatcggtacgttcgcccatcagttcatcaagaacctgcgcgtcacgagcagtacccagcgttgcggtaaccagcgcctgcgtttcaccacgggtgaacagcgcagaaccgtgagtacgcggcagcacgccagtacgcacatccagaccacggatcatatctttttcacgaccgtcgatacgcggttcgcctgccagtacgcggctacgaacaacgtttttctcgatcgcgtgcagaatttcacccagttcgttttcgtccagggtttcgtcttcagcaagcagcgtcgcgatggtttcagatttgatgacatcaacctgcgcataacgctcttgtttgtcggtgatgcggtaagcatcgctcaggcgagcttcagccagtgcagcaacgcgcgcgtttagcgcttcgtttaccggctccggctgccagtcccaacgcggtttaccggcttctttcaccagttcattgatgttctgaataacaacctgctgttgttcatgaccgaacactactgcgcccagcatctggtcttcgctcagcagttgagcttcagattcaaccatcagtacagcggcttcagtaccggcaacaaccagatccagtttgctctctttcagctcgtcctgagtcgggttcagtacgtactggtcattgatgtaacctacgcgggcagcaccaatcgggccattgaacggaataccagacagagacagcgctgcggaagcaccaatcatcgcgacgatatccgggttaacttgcgggttaacagaaaccacggtggcgataacctgaacttcgttgacgaagccttccgggaacagcgggcgaatcgggcggtcaatcagacgcgcgatcagggtttcgccttcgcttgggcggccttcacgacggaagaagctacccgggatacgaccagcagcgtaggtacgctcctgatagttaacggtcagtgggaagaagtcctgacctggtttggcttttttctggccaacaacggtaacgaataccgcggtgtcatccatgctaaccataacagcggcagtagcctgacgagccatcatgccggtttccagagtcacggtgtgttggccgtactggaatttacgaacgatcggattaagcaatgtaatatcctttctctttcttagacagtaccttacggcactggtgttaatacccgatcttctgcgcatcctcgcgactaatgacaaccctaacccagctctatgtgggtaaagcctctcattagccgcgcgaacctctgcaacggaagatcattcatagcaacaatacattagtttccagtgaattgctgccgtcagcttgaaaaaaggggccactcaggcccccttttctgaaactcgcaagaattagcgacgcagacccaggcgctcgatgagctgggtgtaacgtgctacgtctttacgtttcaggtagtcgagcagtttacgacgctgagaaaccatgcgcagcagaccacgacggctgtggtgatcttttttgtgctctgcaaagtggccctgcaggtggttgatctgtgcagtcagcagtgctacctgaacttcggtagaaccggtgtcgtttgcgtcacgaccaaactcagaaacgattttagctgttgcttcagtacttagagacattttaaaactccaaagtatatagaatgaaaggacgccgatctctaattcagcgatcccagtgtacgttacgcaaagtgttaaacaatttacgcgacgttaagcggcagtattctactcgtagcgacctgttatcgcaagacggttaacattacgccgggtattcaaccaccaggcgacgaggcgcaacgcggccttcatcgtcaatttcgcccataccgataaatttgccgttctcaccttccgtgacgcgaaccagtccttccagtggcgcaccagatgtacgaaccgggttaccatttttgaagtaaacagaagacgttaacggaagattcaccaccggatagtccgaagctggactgtccattggcatcagtaatggatcaagtaactccgcggctggaatatcctgctgttcagcttgctcaacaagttcacgcaggtgctccagggtcaccatccgttcaaccggatatttacttaccgccagacggcgcaggtaaataacatgcgcgccacagccgagtttttcacccaggtcatcaatgatggtgcggatataagtgccttttgagcagtgaatttccagctccagctcattgccttcatggcgaataaacagcaattcataaacggtaatcggacgcgcttcacgcggaacttcaatgccctgacgcgcatattcgtacagttttttgccctgatatttcagtgctgaatacatcgaagggatctgttcgatatcgccacggaaagtatccagtgccgctgccagctgctctgcgctaaaggttaccggacgttcttcaacgatctgtccgtcggcatcagaagtatcggtacgctgtccaagacgcgcaatgacccgatagcgtttgtcggagtccagcagatactgggaaaacttcgtcgcttccccgaggcaaatcggcaacatgccggtcgccagcgggtccagcgcaccggtatgcccggcacggttggcgttatatatacgtttcactttttgcagcgcatcgttgctggacataccctgaggtttatccagcaacaaaacgccgttaatgtcgcgaccgcgacgacgaggacgactcattagtcctccttgctgtcgtccgggttaacacgacgttcttcgtcatgtttgaccacgctggtcaccaggtttgacatgcgcatcccttcaaccagagagttgtcgtagaagaaggtcagttccggcacgatacgcaggcgcatcgctttccccagcaggctgcggatgaaaccagaagcttcttgcaacgctttgatgcccgctttaaccgcgtcttcatctttgtcgttgaggaacgtcacatatactttggcatacgccaggtcgcgagacatttcgacaccggaaacggtggtcatcatgcccaggcgaggatctttaatttcacgctgcaggatgagagcgatctctttttgcatttcctgcgctacgcgctgcgggcgaccaaattctttcgccataataaattctcctgacaaaaaaggggctgttagcccctttttaaaattaatttcaggtggaagggctgttcacgttgacctgataagacgcgccagcgtcacatcaggcaatccatgccggatgcagcgtaaacgccttatcccgcatggaaccctaaaaaccttaagcaatggtacgttggatctcgatgatttcgaatacttcgatcacatcgccagtgcggacgtcgttgtagttcttaacgccgataccacattccataccgttacggacttcgttaacgtcatctttgaagcggcgcagggactccagctcgccttcgtagataaccacgttgtcacgcagaacgcggatcgggttgtgacgtttaaccacaccttcggtaaccatacagcctgcgatggcaccaaatttcggcgatttgaacacgtcacgaacttccgccagaccgataatctgctgtttcagttccggagacagcataccgctcatcgccgctttcacttcgtcaatcaggttatagatgacggagtagtaacgcagatccaggctttccgcttcaatcactttacgtgcagaggcatcagcacgtacgttaaagccaaccaggatggcgttggacgccgcagccagggtggcgtcggtttcggtgataccacctacgccagaaccgatgatcttcactttaacttcgtcagtagacagtttcagcaaggagtcggagatcgcttcgacagaaccctgtacgtctgccttcaggacgatattcacttcgtgaacttcgccttcggtcatgttggcgaacatgttctcgagtttagatttctgctgacgcgccagtttaacttcgcggaatttaccctgacgatagagtgcaacttcacgcgctttcttctcgtcacgtacaacggtaacttcatcacccgcagccggtacgccggacaggccgaggatttccaccggaatggacggacccgcttccagcacttcctgacccagttcgttacgcatcgcacgaacacgaccgtattcgaagccacacagaacgatatcgcccttgtgcagagtaccttcacgtaccagaacggtagcaaccggaccacgacctttatcgaggaaggattcgataaccgcaccgctcgccatacctttacgtaccgctttcagctccagaacttccgcctgcagcaggatagcgtccagcagttcatcgataccggtacccgctttcgcagatacgtgtacgaactggctttcaccgccccactcttccggcaggatgccgtactgggagagttcgttcttaacgcgatccggatcagcttctggtttatcgatcttgttcactgcaaccaccaccggtacctgcgccgctttcgcgtgctggattgcttcgatggtctgcggcatcacaccgtcgtcggcagcaacaaccaggactacgatgtccgttgcctgcgcaccacgagcacgcattgaagtaaacgcggcgtgccccggggtgtccaggaaggtgatcatgccgttttcagtttcaacgtggtatgcaccaatgtgctgggtaatgccgcccgcttcgccagaggccactttcgttgaacgaatgtagtccagcagagaggttttaccgtggtcaacgtgacccatgatggtcacaaccggcgcgcgcggttcagccgcagcacccgtgtcacggtcgctcattaccgcctcttccagctcgttttcacgacgcaggataactttatggcccatctcttcagcaaccagctgtgcggtttcctgatcgataacctggttgatggttgccattgcgcccagtttcatcatcgctttgatgacctgagagcctttaaccgccatcttgttcgccagttcgccaacggtgatagtttcgccgatcacaacgtcacggttaacggcctgagcaggcttctggaagccttgctgcagcgaagaacctttacgttttccgcctttaccgccacgtactgctgcgcgtgcttcttcacgatcagcttttgattcagcgtgtttgttgcctttcttcggacgcgctgctttcgcgttacgaccacggccacggccgccttcgacttcacgatcgctttcgtcttctgcctggcgagcatgttgagaagtagtgacgtgataatcgctggaatcttcagtcggttccgcgttatcagtccatttgttttcttccgccatacgacgtgcttcttcagcaacgcgacgtgcttcttcttcgagtttacgacgcgcttcttcttcagctttacgcttgagctctgcagcttcctgctcacggcgggctttttcagcctgggcgtttttagtcatatcgtcttgttgattgctcactttgtctttttccgcagcttcacgtttcgcttgttcagcagcttcacgcttagcttgttctgcggcctcacgttcagctttttgttgcgcctcgcgtttagccgattcttctgcctcacgacgggcttgctcttccgcttcacgctgcgcttgctcttccgctgcaaggcgttcagcctcttgcggatcgcgtttcacaaaggtgcgtttcttgcggacttcgatttgtaccgatttgctttttccaccggtaccaggaatgttaagggtgctgcgtgttttacgttgcagcgtcaatttgtccgggcctgaatttttctgattcaggtggtcaatcaaagtctgtttctcttgtgcagacacagagtcgtcagcagacttccggatacctgcatcagcaaattgctgtaccaggcgttccacggaggtctgtcgctctgcggccagcgttttaatcgttacatctgtcatgctgttccttcctgctacagtttattacgcttcgtcaccgaaccagcaaatattacgggcagccataatcagtgctccggctttttcgtcggtcaacccttcgatatcagccagatcatcaatgccctgttcggcgagatcttccagcgtacaaacgccacgggcggccagtttgaatgccaaatcacgatctaccccttcaaggttcagcagatcgtcagccggtttgttatcaccgaggctttcttcctgggcctgtgcaatggtggccagtgcatttttagcacgctcgcgcagtgcttcaacggtcggctcatcaaggccttcgatttccaacagctctttcatcggcacataggccaattcttccagcgtcgagaagccttcttctaccagaacagtcgcgaagtcttcgtcgatgtcgagatatttggtgaaggtgtcgatcgctgcgtgcgcttccgcctgatgcttagcctgcaggtcgtcaacggtcatcacgttgagttcccaaccgctcagctgcgaagccagacgcacgttctgaccgttacggccaatcgcctgcgccaggttaccggcttcaacggcgatatccatggtgtgtttatcttcatccaccacgatagaagcaacgtctgccggtgccattgcgttaatcacgaactgcgccgggttatcatcccacaggacgatatcgatacgctcgccacccagttcagtagacaccgcctgaacacgcgcgccacgcatacctacgcaagcacctaccggatcgatacgtttatcgttggttttcaccgcgattttcgcacgagaacccggatcgcgagccgctgctttaatttcaatcacttcttcgccgatttctggcacttcaatacggaacagttcgatcagcatttccggcttggaacgagtgacgaacagttgcgcgccacgcgcttccgggcgaacggaatagagcacgccacgaacgcggtcgccagggcggaagttttcacgcggcagcatatcttcgcgcaggatcacggcttcagcgttgttgcccagatccagagagatgttgtcgcggtttacttttttcaccacgccggtgatgatttcaccttcgtgttcacggaactgatcaaccaccatcgcacgttcggcttcacgcactttctgcacgataacctgttttgccgtctgggtagtgatacggtcaaaggtaacagactcaatctgatcttcaacgtaatcgcccaggttcaggctttcatcttcataacgtgcggcttcaagggtgatttccttggtcggctgggtgacttcatcaacaactaaccagcgacggaaagtgtcaaaatcaccgcttttgcgatcgatctgtacgcggacgtcgatctcttgttcatattttttctttgttgctgtcgccagcgcgctttccaatgcttcgaaaatcttctcgcgaggtagcgccttttcattggatacggcttcaactacagccaaaatttctttgttcatcgcgggcttttcacctcatccagactattaaaagtggggaaccaggttcgccttctggatattactcagcgcgaacacttcatctttaccttcgacggtaactgtgatcatttcaccgtctaccgctttgataacgccctgccatttacgacggttttgtaccgccatacggagaaccagagtcacctcttctccgacaaaacgggcgtagtgttcagccgtgaacagtgggcgatcgagacccggtgaggagacttccaggttataagcaacggtgatgggatcttcaacatccagcacagcacttacctggtggctcacatcagcacaatcatcaacattgatgccatcttcactatcaatatagatgcgcagtgtggatgtgcgaccgcgaataaattcgatgccaaccagttcaaaacccagggcctcaactggcgcagtaatcatctctgttaatttttgctctaatgtggacaagcccacccccaagacataaaaaaagggcctaaagcccagttattctgtagtcagataacaaaaaaccccgataaatcggggctttatataactgaaccctataaccgcaactgcggtctggagcactttccagaaggattttttcaaatcccactacgaaggccgaagtcttcacagtatatttgaaaaaggactctaagggaaagtggttgcgggggccggatttgaaccgacgatcttcgggttatgagcccgacgagctaccaggctgctccaccccgcgcctgaaacgtggcaaattctactcgttttgggtaaaaaatgcaaatactgctgggatttggtgtaccgagacgggacgtaaaatctgcaggcattatagtgatccacgccacattttgtcaacgtttattgctaatcatgtgaatgaatatccagttcactttcatttgttgaatacttttgccttctcctgctctcccttaagcgcattattttacaaaaaacacactaaactcttcctgtctccgataaaagatgattaaatgaaaactcatttattttgcataaaaattcagtgagagcggaaatccaggctcatcatcagttaattaagcagggtgttattttatgacgacgattctcaagcatctcccggtaggtcaacgtattggtatcgctttttctggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctacaaaggaaacgatatcgaacgtttctatcgttatggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcctactccacagactccaacatgcttggtgcaacgcatgaagcgaaggatctggaatacctcaactccagcgtcaaaatcgtcaacccgattatgggcgtgaaattctgggatgagagcgtgaagatcccggcagaagaagtcacagtacgctttgaacaaggtcatccggtggcgctgaacggtaaaacctttagcgacgacgtagaaatgatgctggaagctaaccgcatcggcggtcgtcacggcctgggcatgagcgaccagattgaaaaccgtatcatcgaagcgaaaagccgtggtatttacgaagctccggggatggcactgctgcacattgcgtatgaacgcctgttgaccggtattcacaacgaagacaccattgagcagtatcacgcgcatggtcgtcagttgggccgtctgctgtaccaggggcgttggtttgactcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtattggtcaattgaccatgcgtaacctggatatcactgatacccgcgagaaacttttcggttatgccaaaactggcctgctttcctcctctgccgcttcaggcgtgccgcaggtggagaatctggaaaacaaaggccagtaattcgacatcaaccctgcccttcaggggtggggttaccttgcttatcctctgtaaactcctttctgagcatcacataatcgaaaacatcatggtttgcatccacaacccgtgagtctcctttatagtgtgcaatcacttcctcaagcgtttgcggctgttccggctttgttacccccatccacgcattaataaggtaattattgtaagctgtcgaaaagatgttgttttccgttgtgcgatccacgccatccccaagaacggggctataccagataaacatcgggacatgatatgcctgctggctagcctccctgcctccatgaaaatagacgttcttcttcgtagggtcacgttccaggccgtggtcggcaaaatacatgaccgaggcgcggcgatcttttaataattcaaaaacctgacctagcaaactatctgtgtaatgaatggagttgtcatagcaggcatcctgatcgtcctgcggttgaaacacggcgctggattgcggataggcgctacaagccggttcatggcttccatttaaatgaagaacaatcagtttcttttgctgcgtattttgctgtaatgcttgcgataaatgcggcaacaacaattcatcaaatcctctgacataaactgtttccatggcgcgcatggcgatactggtaactgctgtaccattctgccgaaaagcggattgcgagcttagccagaaagtctgaaatcctgcttgattagccatattaataatgttgtcggggtaattatgaatgtcatgactcaaaacagaatcagcagttaaagaaaggggaaccgacagcgcagtgtaaggtgcgccgcttattgcttgattaaacagtttgatctgttttctttgtgcttcaacttgcggtgtcgtagagcgtgtatatccatacaaagacatattgtcgacacgtacagactcccccacaatcaacacgtaggtatcaatacctgtatccctgactgataattgaaaatacggcaccgtgtttgcaattgagagtaatctttgatgctctttcgctgctaaagcaaaatagttgagattgaaaaacggcgtataggtagcaaatcgcgacgctagtatatatggactgaacgcttttttattttttgcatctttataagcaaattgacaagcggaaaataaactgcccgaaatgacaatcagcaataatattcctgtcactttttttgtcggcaaggaaacatcatattttattattactgccaaaaaaagaagggataaaaaagcaaaggcacatagataagggatatacatccccagcattttgacaacttcatccggatcactctggagcacactaatcgcaaatccatcattgaaagttgtaccaaaggtacaccatgaatagaggctaatactcatgtctgccgcagtcagtaacacaaatggtgcggcaacaagcaggcgaagcggaagggatgatatacgttttacaaccaggatggtcagaacgaagaacagcaagcgctgaaccatatgcgctccggaagaagcgactaagttcgtaataccaaaaacaataacacaaagatacaacaaccaatgagatttaaaagttctagcaaatttgttgaatactgtcatccagaaatccaagttcacaaccaatataaacaattatcaacaatgtttaattttatatcagacatgtttttcaactctgatccatatcagaacgaaacactgttagttttttctttttaaatgatgcggccattgcgttctcagtaattaaataacattatcaatgcgtctctaaacattacgcagaacgtagccatcagtcgttatactgacaggagcaggatggtttatcgagaagtaaacatatccgtattcgtaccggaactggagttgacacaataaagtgccaattatgtcagtagaagggaaaaatttataactaaggcgtaccggcaccatcgtttcaaggtaccagctacgagtaaagcaactggacgagatacagatacctgacaaccattcctcagaccaggaccaaaacgaaaaaagacgcttttcagcgtctcttttctggaatttggtaccgaggacgggacttgaacccgtaagccctattgggcactaccacctcaaggtagcgtgtctaccaattccaccacctcggcacggatactactttttagttcgggatatcgctggtcggcttagccggagcagctggctgagtttgttcggttttcgccggtgcactcagattttcccattcgctacctttattggttttgttgctattgatgttacccagcaccagactgatgatgaagaataacgttgccagcagcgccgtcatgcgggtcatgaagttaccagaaccacttgaaccaaacagcgtagcggaagcgcctgctccgaaggaggctcccatatcagcgcctttaccttgctgcagcatgatcagaccaacaaggccaattgccacaataaggaaaactactaaaagagcttcatacataatcaacctgttccttgcggagttgccgcgtaccaatgcttcaaccaataaagcgggagtttttaatctttcccactgaagcgggtgtgaatactaaccaaagcgaatgaccttcgcaagggcaattttatcgcattgtatcaactgcggaaaaaaacagcaaaaccgatgtgttcgctgagaaaaaaggcgacaatcgccgcctttttagccagttatctaacgctttaaacggcttttactgcatcggcgatgcggtgtgcaaattcagtcacctgcgcttcgtcttcgccttccaccatcacgcgaattaacggttcggtgccggatttacgcagcaacacgcgtccacggttgcccagcgcagcttcaacctctgcggtcacggctttaactgactcatgctcaagtggatcgccgctacctgcggtgtaacgtacgttaaccagaatctgcgggaacattttcatgccgctgcaaaggtcgtgcaggctcatatggttacgtgccatcgccgccagcacctgcaagccagcaacgatgccgtcaccggtagtagttttatccagcaggatcacatgaccggaattctctgcaccgatacgccagcctttctcctgcattttttccagtacgtagcggtcacccactttcgcgcgcgcaaatggaattcctaactgtttcagcgccagttcaagccccatgttgctcatcaatgtacccacagcgccaccacgcagctggccctgacgaagaccttcacgcgcgatgatatacatgatctgatcgccatcgactttattgccttcatggtcaaccataatcacgcgatcgccatcgccgtcgaaggcaataccgagatccgctttttcagccagcacacgagcctggagcgcgcgaacgtcggtagcccccacttcggcattgatgtttacaccgtttggctcacaaccgatagcgataacgttcgcccccagttcgcgcagcacgttcggcgcgatgtgataagtcgcaccgtttgcacaatccaccacaatcttcagttcactgaggctaagttcgttcgggaacgtggctttgcaaaactcgatatagcgacccgcggcatcaacgatacggctggctttacccagttctgccgaatcaacgcagctgatctccttttccatttccgcttcgatggcctcttctaccgcatccggcagtttggtgccgtcgatagagaagaatttaatgccattatcgtagaacgggttatgcgatgcagatatcacaattccggcctctgcgcggaaggtacgcgtcagataagccacggccggtgttggcatcgggccagtgaagagtgcggaaaggcccgctgccgccagacccgcttccagtgctgactccagcatatagccagaaatacgcgtgtctttaccaataataatcttacgggagccgtggcgcgccagcactttacccgcggcccaacccagcttaagcacaaaatcaggtgtgatcggcgcatcccctacacgaccacgaatcccatcggtaccgaaatatttacgattactcatagcgtttgttttcctttgcagacagagtggcttccaccacccgcatcgcttctacggtttctttgacgtcatgaacacgaatgatgtgcgcgccttgcattgcggcaatgaccgcacaggccagactaccgctcaggcgctcggacggccccacgttcagcagctgcccaatcatcgattttcgtgacatacccaccaacagcggcaggttgaaatggtgaaattcagccaggcgcgccagtaatgaatagttatgggagagatttttaccgaaaccgaatccggggtcgagcaacaatttctcttttgcgatacccgcctgctcgcaacgtgctatttgctcaataaagtagcgattcacttctgcaaagacatcgtcatacttcggagcttcctgcatggtttttggatttccctgcatatgcatcagacaaaccggtaaaccggtttctgcagccgcctccagagcgccaggttcggaaagggagcggatatcattaataatgtgagcgccaactttcgctgactcacggatgacttctggtttggatgtatcgactgagatccagacttcgaagcgttgagcaattgcctcaaccacaggaataacacgttgcaactcttcttcaacgctaacttccgccgcccctgggcgcgtggactcgccaccaacgtcaatgatcgtcgcgccagcgttgatcatcagattcgcatgtttcaccgcatctatcagcgagttatgcgtgccaccatccgaaaaggaatcaggcgtgacgttgaggatccccattacgtgaggatggctaaggtccagtgaagtaccctgggcaaagagtttcatgatgttatccctggtatgaattgataagaaaaaaccccggagcacgccccggggttttcggtacaaatacagtcatctgatgcgggaacttacttgtcgcctaactgctctgacatggtgttacccgggttcggcgtacgcggttcatcaaccggacgaggagcctttggactaccattgtcgccagaattgttagaagcgcctggttcttcccagcccgctggcggacgtacatcgcgacgtgccatcaggtcatcaatctgcggtgcgtcgatagtctcatatttcatgagagcatctttcatcgcatgcagaatatccatattgtcggtcagaagctgacgcgcacgattatagttacgctcaatcagtgctttcacttcctggtcgatgatacgtgcagtttcatcggacatatgtttcgctttcgctacgctacggccgaggaacacttcaccttcttcttccgcgtacagcagtggacccaatttctcagagaagccccactgagtcaccatgttacgtgccaggttggtcgcaactttaatatcgttggacgcaccggtagatacatgttccggcccgtagatgatctcttctgccagacgaccaccgtacagcgtagaaatctggctttccagtttctgacggctggcgctgattgcgtcgccctcaggcaagaagaaagtcacacccagcgcacgaccgcgtgggataatcgtcactttgtgcaccggatcgtgttccggcaccaggcgaccgataatcgcatgacccgcttcgtggtaagccgtcgattctttctgcgcttccgtcatcaccatggagcgacgttccgcacccatcatgattttgtctttcgctttctcgaactcaaccatcgacacaacgcgtttgttgccacgagcagcgaacagtgccgcttcgttcaccaggttcgccaggtcagcaccggagaaaccaggagtaccacgggcaatgattgccgcgtcgatatcgggtgccaatggtacgcgacgcatgtgaactttcaggatctgctcacgaccgcgaacatctggcaagccgaccacaacctgacggtcgaaacggccaggacgcagcagggccgggtcgagaacgtccggacggttagtcgcggcgataacgatgataccttcgttaccttcgaagccatccatctcaaccagcatctggttcagagtctgttcacgttcatcgtgaccaccgcccagaccagcgccacgctggcggcctacggcgtcgatttcatcgataaagatgatgcacggtgccgctttcttcgcctgttcgaacatgtcacgaacacgggatgcacccacaccgacgaacatttctacgaagtcagaaccggagatagtaaagaacggaactttcgcttcgcctgcaatcgctttcgccagcagcgttttaccggtacccggaggaccgaccatcaagacgcctttcgggatcttaccgccgagtttctggaagcggctcggctcgcgcagatactcaaccagttcagcaacttcttcttttgcttcgtcgcagcccgcaacgtcagcaaaggtcgttttgatctgatcttccgtcagcatgcgcgctttgctcttaccaaacgacatggcacctttgccaccgccgccctgcatttgacgcatgaagaagatccagacaccaatcagcaacagcatcgggaaccaggagatgaagatagaagccagcaggcttggttcttcaggcggttcaccgacaaccttgacgttcttggtcaacaggttatccagtaatttcggatcctgaaccggaatgtaagtggtataacggttactatctttcttggtaacgttgatttcacgtccgttgatacgcgcttcacgaacctggtcgttattgacctcttgtaggaaggtagagtaatccaccttacggccattagactcgctgggcccaaagctctggaatactgacatcagcacaacggcaatgaccagccagagtattaggtttttcgccatgtcactcaagggattaacctcttattacaactgtgttaaaaacagcgtcaggatactctatatccagcatctttcaaactttcgtctgaaatctcccggttagggtttacgcccggtcgctacaatatacacttcccgcgaacgtgcacgagaagagtccggcttacgaactttgaccttcgtaaacagggagcgaatttcccttagatactcatcgaaaccttcgccctggaacaccttcactacaaaactgccacctggcgctaatacatcacgacacatttctagcgccagttccaccagatacatggcacgggggatatccaccgccggtgttccgctcatgtttggtgccatatcggacatgacaacctggactttgctgtcgccaacgcgctccagcagtgctttcatcaccagttcatcacgaaaatcgccctgaagaaagtccacaccaacgataggatccataggtaaaagatcgcaagcgatgatgcggcctttgccgccaatttgggtgaccacatattgtgaccaaccacccggagcagcaccaaggtcgacaaccgtcattcccggtttaaagagtttgtcactttgctgtatttcatcaagtttaaaccaggcacgggaacgtaacccctttttctgtgcctgttgaacatatttatcgctaaagtgttcctgaagccagcggctggagctggcagaacgcttcttacctgtcatttaactttcccatggggataactcatcgtaaccaattgcgtaaatttttacgcgcctatttggtgatatatgggagatggcggtagaatgacccgttttcaatcccaacgtaagcaaaaaatacgatgaatctgagtactaaacaaaaacagcacctgaaaggtctggcacatccgctcaagccagttgttctgcttggcagtaatggtttgaccgaaggggtgctggccgagattgaacaagcgttagagcaccatgaactcatcaaggtgaaaatcgccaccgaagatcgcgaaactaaaaccttgatcgtggaagctatcgtgcgcgaaaccggcgcctgtaatgtacaggtcatcggtaaaacgctggtgctttatcgcccaactaaagaacgtaaaatctcgctgccacgctaagattatcctaaagttacacacatttgctgtgtaaaacgaggggttttccgcaggcaggagagcaaaatgccacgctctgttcgttgataaaaggccgcatagcggcctttttcctttctttacaatacatcaacatcttgagtattgggtaattcttacaggtattccaccttaattacttcaaattctacttcgccgcccggcgttttgatgaccacaacatcatcttcttctttgccgatcaggccacgagcaataggcgagtttacagaaatcaggttttgtttaaagtcagcttcgtcatcgccaacgatgcgataagtctgttcttcgtcagaatccagattcagcaccgttacggtagcaccaaaaataacgcgcccattgttgggcattttggtgacatcaatcacctgcgcgttcgacagcttggcttcgatgtctttaatacggccttcgcagaaaccctgctgttcacgagctgcgtggtattcggcgttttctttcaggtcgccatgctcacgcgcttccgcgatagcagcaatgatttcaggacggcgcacagatttcagaaaatccagctcttcgcgtaatttttcagcgccgcgtaaggtcatcggaatagcttgcatttgttatacctcttgaatattcctgatagggcaagtcttcacccaccccggctgttcggcctgcccggcataactccttaccgggaccagaagcaaaaaaataccgacccgggtacaagtcccaggtcagctacaattcacattttgatagtcattttaccctgaagttcccgaagggtcatcgtttactttatagggcgttgcgccgtagtatgacggctcgattccaggttgttagcgcgagattatgcgattttccagatttatcatcggattgaccagctgtatagcgttcagtgttcaggccgcaaatgttgatgagtacattactcaactccccgctggtgccaaccttgccctgatggtgcaaaaagtcggcgcgtcggcccccgctattgattaccacagtcagcagatggcgctgcctgccagtacccagaaagtgattactgcgctggcggcgttgattcaactcggccccgattttcgttttaccacgacgcttgaaaccaaaggcaatgtggaaaacggcgtacttaagggtgacttagtggcgcgatttggtgccgatccgacgttaaaacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccgtctcgctctacagtgccccaaagcctggtgatatggcttttatacgcgtggcatcttattaccccgttacgatgttcagccaggtacgcaccctcccccgtggttctgccgaagcgcaatactgcgaactggatgtggtgccaggcgacctgaaccgctttacgctgacgggatgcctgccacaacgttctgagccgctcccgttggcttttgccgtgcaggatggagccagctatgccggtgcaattctgaaagatgagttaaaacaggcgggtatcacctggagcggaacactgctgcgccagactcaggttaacgaacctggaacggtagttgccagtaaacagtcggccccgctgcacgatctgcttaagattatgctgaaaaagtcggacaacatgatcgccgatacggttttccgcatgataggccatgcgcgcttcaatgtgcctggaacatggcgggccgggtcggacgccgtgcgtcagatcctgcgccagcaagccggtgtcgatattggaaacaccattattgccgatggttcagggctttcgcggcataacctgattgcccccgccaccatgatgcaggtgctgcaatacattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagcgagcgggcaacgaatggcgtttgtgcaatatctttctggctatgcagtagaacctgcggatcagcgtaatcgccgtattccgttagtgcgttttgaaagccgtttgtataaagatatttatcagaacaattagtcaaaaagaaaccccggcacatggccggggcttcagattattgacaaagtgcgctttgtttatgccggatgcggcgtaaacgccttatccggcctacaaaatcgtgcaaattcaacatattgcaattctcttgtaggcctgataagcgtagcgcatcaggctgatttggcgtttatcatcagtgattaacgcttgtaaatgaactcaacgccttcttcgtcgtcttcgtcccagtcgtcatcccagtcttcatcatcctcttcagcaatctcttcaagctgctggcgatgataatcatcccacatgaattcgactttctctggctgtttcgcttcttcagcctgcacgaccgggttttcaatgataaaggtcatcacatcccagcagagatctttcacgcccagtccactcgccgcagagatcagataatatttatcttcccagcccagcgcctcagcgatcgctttcgctttctcttcggcttctaccttatccagcagatcgatcttgttgaacactaaccaacgcggtttcgtcgccagatcctggctgtatttttccagctcgctgataataatacgcgcgttttcaaccggatcggtgccgtcaatcggatcgatatcgatgaggtgcaacaggacgcggcaacgttccaggtgcttcaggaagcgaatgcccagacctgcgccttccgcagcgccttcaatcagtcctggaatatcggcaacaacgaagctcttttcgttgtccattcgtaccacacccagacttggcaccagagtggtaaacggataatccgccactttcggtttagccgccgataccgcacgaataaaggtcgatttacccgcgtttggcatccccaacataccgacgtcagccagcagcatcagctccagcagcagctcgcgcttatcgcccggcgtgccgttggttttctgccgcggtgtacggttaacggacgatttgaaacgggtattgcccagaccgtgccagccgcccttagcaaccagcagacgctgaccgtgtttggtcatatcgcccatggtttcaccagtaccctggtcgattacacgcgtacctaccggcactttaatcgtcacgtctttaccgcgcttaccggtacagtcgcggcttgcgccattctgaccgcgctctgcacggaaagatttttcaaaacgataatcgataagcgtgttcaggttctcgtcggcttccatccatacgtcaccaccatcaccgccgtcgccgccatccgggccgcctttcggaatatacttttcgcggcggaagctcacgcaaccattaccgccatcacctgcaacgaccagaatcgatgcttcatcaacaaacttcattttattctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaaggtattcagtccgcaaaaaattaaacatgcgagctgccagtggctaagctgcgctatcactccaggctttgccagagggaagagcgcaattgtacataaagtgtacagtaaaaacaggatctgcggtgaggccagccgacgcaataaaaccttttgcgccacgccataactcacccaaaccgtcgccgcaccgaccccaaagataactccccaggtgtaatcggtgagctttgtaaatatctcgaccagactggtgttaaaaaacatcaccaggccgctcaggagcatcaatgcccctacaacctgagtgctgcgcattttctctttgaggataaatacgctggcaaccatcatgccaactggcgagagttgcccaatcacctgcgaagcggtcggactcaggtattgcaaggatgagctgaacaggatgaagttcccaaacagcccggcggtcgccactgccaacaaaatcaaccagcgtggcttacgaaacacgcgtaatggcggcaacctcttcttcaccgcaagaatggcacccaggccaatactcgccatcaagaaacggtaaaacacgattgtcggaggttccatcacctccagcacctgcttcattgcgattggcaacgccccccagcaaattgctgtggtgagcgccaaaagaatgccaatgcctgcctgctgcttcataccgtattccctgcaaagcgcatttgcggattaacgtcgcaccatgcgcatttttaccggttatcgaatgtaaaaagccccgcaacgtgttgcggggctttcatccgttaccgggacgcgaaaaacttattcagcttcgatgctgataaatttacggtttttcgggcctttaacttcgaatttcactttaccgtctgctttagcaaacagagtgtggtcacgaccgcaacctacgttagcgccagcgtggaatttggtaccacgttgacgaacgatgatgctacccgccagaacggattcgccaccgaaacgcttaacgcccaggcgtttagcttctgaatcgcgaccgttacgtgtggagccgccagcctttttatgtgccatttgaaatctctcctcaggtcttaggcgctgatgccagtaattttcacatcagtgaaccactgacgatggccctgctgcttacgatagtgtttacgacgacgaaacttaacgattttaactttctcgccacgaccgtgagcaacaacttcagctttgattacgccgccatcaacgaaaggaacgccgattttgacttcttcaccgtttgcgatcatcagcacttcagcgaactcaacagtttcgccagttgcgatgtccagcttttccaggcgaacggtctgaccttcgcttactcggtgttgtttaccaccactttggaaaaccgcgtacatataaaactccgcttccgcgcacaccttttcaatgattcagagtgcgctataaatattcacaatagggcgcgaatattacgcaaaacgcacgcctttgacaagtgctacagtcaatacacgaagaaaaaaaacacaacttgtacggtaacgtttatctgtgccattttttcagtacaatcaccctatattcctaaccataaaccctaagttgcctttgttcacagtaaggtaatcggggcgaaaagcccggcttttgcgatgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgctttccagatgatgaccagcctcggttcgctcaaagtgctggaagtcatgtcagaagccgtaaacgtcatcgcagaaggtgaagttctgcaactgatgaacgttaacgatccggacatcactgaagaaaactacatgcgcgttatctatagcaaaaccgcgcgtctgtttgaggctgccgcgcagtgttccgggattctggctggctgtacgccggaggaggagaaaggcctgcaggattatgggcgctatctcggcactgctttccagttgatcgacgatttactcgattacaatgccgatggcgaacagttaggtaaaaatgtcggcgacgatctgaacgaaggtaaaccgacgctgccgctgctgcatgcgatgcatcatggcacaccagaacaggcacagatgatccgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccttggcgagaagcactcatcggcctcgcgcacatcgctgttcaacgcgatcgttaatcccctcccctcatcccgcgcagcgcgcgggatggttccagtaagttccataaaaacacttattcagctctataacacctgaaaaatagggatgtgcatctttatatattctgaatattcacactctttacaggaactttttagagcaataggccatcaggagtatagtgatgctcgacagaagaagtgttctgaatgaaagcgactaacttaaggagtgaggaaaaatggaaagtaatttcattgactggcatcccgctgacatcattgcgggtttgcgcaagaagggaacgtcaatggcggcggaatctcgcagaaatggtttgagttcctcaacgctggcgaatgcattatcgcgcccatggccgaaaggagagatgattattgcgaaagccctgggaactgacccctgggttatctggccatcacgctaccatgatccgcagacccatgagtttatcgacagaacgcagttgatgcgtagctacactaaaccgaaaaaatgagtggtctggcggtagccccgcgaacggggctgccagctctcagacgattattcgcctttcacacgctcaatatttgcacctaaagcgcgcagtttgtcttcaatgcgttcgtagccacgatcgatgtgataaatacgatcaaccaccgtcgtcccttccgcaatacagccagccagcaccaggcttgctgatgcacgcagatcggttgccataacctgtgcgccagaaagtttttcaacaccgtgacaaataacggtattgctttcgatttcggcgtgcgcgcccatacggctcagctctggcacatgcataaagcggttttcaaagaccgtttcggtgataaacccggtcccttctgccaccaggttcaacagcgtgaactgggcctgcatatcggtcgggaatgccggatgcggcgcggtacgtacgttaacagccttcggacgtttgccatgcatatccaggctaatccagtcttcgccgacttcgatgtccgctccagcgtcacgcagtttcgccagcacggcgtcgagagtatctggctgcgcgttacggcagataattttgccgcgagaaatcgccgccgccaccaggaaagtaccggtttcgatacgatccggcagaacgcgatagacaccgccgcctaaacgttccacaccttcgatgacgatacgatcggtgccctgaccgctaattttcgcacccagcgtaatcaggaagttcgcggtatcgacgatttccggttcacgcgctgcgttttcaataatcgtggtgccttccgccagggttgcagcacacatgatggtcaccgttgcgccaacgctgactttatccatcacgatatgtgcacctttcaaacgaccatcgacggaagctttaacgtaaccttcttccagtttgatggtcgcgcctaattgttcgaggccagaaatgtgtagatcaaccggacgcgcaccgatcgtacaaccgccaggtagtgaaacttgcccctgaccaaagcgcgctaccagcggccccagcgcccagatagaagcacgcatggttttaaccagatcgtaaggtgcgcagaatacattaacgtcgcgggcatcaatatgcacagaaccattacgttctactttcgcacccagctggcttagcagcttcattgatgtatcgacgtctttcagtttcgggacgttctggatctctaccggttcttccgccagtagtgcggcaaaaaggataggcagagcagcatttttagcgccggaaattgtgacttcgccctggagcttcgttggcccctgaacacgaaatttatccatttagtttgttctcagttaacaattcatatccgctaccggcgaatcgcccatagctcaaaagccgttcagtttgcgatcgcgcgcccactccgcaggggtatacgctttgatcgacacagcatgaatgcggttatccgcaatatattccatcagcggaccatagaccgtctgctgttttttaacccgactcatgccgtcaaacaactcacccacggcaataacctgaaagtggctgccatcgccggaaacgtggacttcctggagggagagagcgttcatcaacacgctctgaatttcattattttccatgggatcttcaatcatcagttaataaaccagcgaaacatcttagagcaaagttgcgctggcataaataagcaaaaagcctcgctgataaatcagacaaggctcgacttgcaggcaggtttgccggacaggcggttaacgccatatccggcctgaaaaaatttaacgaggcagaacatcagcaggcaaattatacaatttcgccagggtatacactttgtcgtttaccccctgaagcgtcacattgttgccctgctttttcgccagatcgataagatggagcagcagtgccagtccccccgtatccacgcgggagacacggctaagatcgatgcaggtaatccccttcaccgcttcctcacgcatttcccaaagcggtagcaaaacgtcctgatccagctctccggataacgccagcgtgtcacccgtctgcatccagctcagtgactcgctcattattttttctcttccagagtgattttctgttgagaaatcgatttcagttgcgcagtcaggccgtcgatacctttggtacgcagcagcgttccccactcgttttgtttggtggtgatcatactgacgccttcagcaatcatgtcgtaagcctgccaattgcccgtctgggagtttttacgccactggaagtccagacgcaccggcggacggccattcgggtcaataatggtaacgcgaataggcacaatggttttatcgcccagcggctgttctggcgcaatctgataggtttgaccgtgatacatcgccagcgcctgaccgtaagcctgcttcaggtactcacggaaagcggcaaagtaggcttcacgttgagcaggggtcgcactcttgtaatactggcccagcaccagcgcaccggcgtatttcacctgtacgtatggcagcagttcctgatcaacaatggtacgcagataatccgggttggcccgaatttgcggttgctcattcttcaggcgatcgaacgttttctgcgccgcctcgtccatcagcttatacggattggtctggtctgccgcggttgccgcactcagaggtgcaatcaccagcaaagcgaccatcattaaacgtttaaacatgcgtcggttctcctgaaattatttcgttgtacccacaggttcagtggtttcattattacctggcgcagcagctggcgcatcgccactattcttattgtcatcgcctttactaccgtaaaggaactgaccaatgagatcttccagcaccatcgcagacttagtgtcctgaattgtatcgccatccttcaggatagcagtccccagttccgggtcttcaaaaccgacgtttaatgccagatattgttcccccagcaggccggaagtacgaatgctcagcgaactggtatctggaatgtggttataacgttgttcaatttccagcgttacgcgcggcagataggttttcgggtccagcgtaatatccgccacccgacccacaacaacgccaccaatactgaccggagagcgcgctttcaggccgccaatgttatcgaacgtcgcataaagcgtgtaggtcggttcagtacgtatggacgtcacgttcgccgccttcaggcaaacaaacagcgccgccagcagtgctgctaataaaaagatacccacccaaatttcattttttttcgtttgcatgaactcaattcccaaacatcaatgcggtcagcacaaaatccagccccagaacagccagagacgagtggacaacggtgcgagtggttgcccggctaatcccggcagacgtcgggatggcgtcgtagccgttaaacaacgaaatccacgtcaccgtgatggcgaacaccacgctcttaatcagacagttgaccagatccatacgccagtcgacggcattttgcattgccgaccagaagaacccgctatcaatgcctttccaactgacgccgaccagagatccgccccagatccccacggcgacgaaaataaccgtcaacagtggtaatgaaataaccccagcccagaaacggggagaaataacccgacgcagcggatccaccgccatcatctccatactggagagttgctctgtagcgcgcatcaggccgatttctgcggttagcgccgaaccagcacgcccggcaaacaacaacgcggcaaccaccggccccagttcacgcagtagcgataacgccaccagcatacccagactggtttccgcactataagtggtcagaaccagataaccttgcagccccaacaccattccgatgaacacgccagaaaccacaataatcagcatcgacaggacgccgacattatagagctggcgcaccagcagcggcgcatgtttgcgaaattccggtttgccgaccagcgcattgaataacattaacccggcccgcccgaacgttctcagggttttaatccctttatgtccgagcgacgccagcgcatttaacagcatgagtggcttaactccctggtaaaagatcagcgtgataatcgccggcaggatagcggaacggaacaggcccgtcagctatcccgtccagaaactgacgtacgcgcggatcaggattcgcctgcaacgcctgggcactgccatgagcgacaatttttttgtccgccaggatccaggcgtgatccgcaatacttaacacttccggcacatcgtgagaaaccaccacacaagtcacgcccagcgcgctgttcagctcagaaatcagcttcaccagtacgcccatggtgatgggatcttgcccaacaaaaggttcatcaaacatgatgagatccggctccagcgcaatcgcacgcgccagcgctgcacgccgcgccatcccaccggaaagttcagaaggcattagtttagccgctccacgcagccccacggcctccagcttcatcatcaccgtactatgcaacaatggcgcgggaagttgggtatgttcgcgcagtggataggcgacgttgtcaaatacgttcatatcagtgaacaacgccccggactgaaataacatgctcatccgtttgcgcactgtatacaggcgcgaacgagacatcgccggaatattctcaccatcgaaaaggatctcaccatgatctggtgcgatttgcccgccaatcagacggagtagcgtcgttttaccgatgcccgatggccccatgatcgccgtgatcttccctcgcggcacggtcagggaaatattatcgaagatgcagcgattgccacgcgtaaaactgacatcgcgcatatcgactaaattcgccacagactgctccataattcacccttcgtcttgcgttgattttctaagcatggcgctcaatttaaccttgaacccaacatatttacagaatattacccgccgtggttagcgaaagctggcatttgttttactttttagccgcataaagtcaaaattaagcatccgttacggctttctgaaaatcttcagcggaccggcgagtatacctgaagaaaggacgttagatgcttttagctacggcactgttaattgttggtttacttttggtcgtttacagtgccgaccgcctggtttttgccgcgtctattctttgccgaacctttggcatcccgccgctgatcatcggcatgacggtggtcagtattggtacatcgttaccagaagtcatcgtctcgcttgccgcgtctctgcacgaacaacgcgatttagccgttggtacagccctcggctcaaacattatcaatatattgctgatcctcggtctggctgcgctggttcgtccttttaccgtccattctgatgttctacgccgtgaattacccttaatgttgttggtcagcgtggtggccggttccgtactctatgacggacaacttagtcgcagcgatggtatctttctcctctttctggctgtgctatggctgctgttcattgttaaacttgcacgtcaggctgaacgtcaggggactgacagcctgaccagagagcagcttgcagagctgccgcgtgacggcggattgcccgtcgcgtttttatggctcggcattgcgcttatcatcatgccagtggccacgcggatggtggttgataacgccacggtgctggcgaattactttgccatcagcgagttgacgatgggtctgacggcaattgctatcggaaccagcctgccggaactggcaaccgcaatagcgggggttcgcaaaggtgaaaacgacattgctgtcggaaatatcattggcgcaaacatttttaatattgtcatcgtgttgggtttacccgcgctgataacgccaggagagattgatccactggcgtacagtcgtgactacagcgtgatgttgctggtgagcattatttttgcgttgctgtgctggcggcgctccccgcaaccgggccgtggtgtaggggtattattaactggcggatttatcgtatggctggcgatgttgtactggttatcgccaatactcgttgaataactggaaacgcattatgtcgcacgtagagttacaaccgggttttgactttcagcaagcaggtaaagaagtcctggcgattgaacgtgaatgcctggcggagcttgatcaatacatcaatcagaatttcacgcttgcctgtgaaaagatgttctggtgtaaagggaaagttgtcgtcatggggatgggaaaatcggggcatattgggcgaaaaatggcggcaacgtttgccagcaccggtacaccttcatttttcgtccatcctggtgaagccgcgcatggtgatttaggcatggttaccccacaggatgtggtgattgctatctctaactctggtgaatccagcgaaatcacggccttaattccagtgcttaagcgtcttcacgtaccgttaatctgcatcaccggtcgcccggagagcagcatggcgcgcgccgcagatgtgcatctgtgtgttaaagtagcgaaagaagcctgtccgttagggctggcaccgaccagcagcaccaccgccacgctggttatgggcgatgccctcgctgtcgcgctgttaaaagcacgcggctttactgctgaagattttgcgctctcacacccaggcggcgcactgggtcgtaaacttctgctgcgcgtaaacgatattatgcatacgggcgatgagatcccgcatgttaagaaaacggccagtctgcgtgacgcgttgctggaagttacccgcaaaaatcttggtatgactgtcatttgcgatgacaatatgatgattgaaggcatctttaccgacggtgatttacgccgtgtcttcgatatgggcgtggatgttcgtcagttaagtattgccgatgtgatgacgccggggggaatacgtgtgcgccctggcattctggccgttgaggcactgaacttaatgcagtcccgccatatcacctccgtgatggttgccgatggcgaccatttactcggtgtgttacatatgcatgatttactgcgtgcaggcgtagtgtaaagattcaaggataaacaacaatgagcaaagcaggtgcgtcgcttgcgacctgttacggccctgtcagcgccgacgttatagcaaaagcagagaacattcgtctgctgatcctcgatgtcgatggcgtactgtcagatggcctgatttatatgggcaataatggcgaagagctgaaagcgttcaatgttcgtgacggttatggcattcgttgtgcgctcacctctgatattgaagtcgctatcattaccgggcgaaaggctaaactggtagaagatcgttgtgccacattggggatcactcacttgtatcaggggcagtcaaacaaactgatcgcctttagcgatctgctggaaaaactggcgattgccccggaaaatgtggcttatgtcggcgatgatctcatcgactggccggtaatggaaaaagtgggtttaagcgtcgccgtggccgatgcgcatccactgttgatcccgcgcgccgattacgtgacgcgcattgctggcggtcgtggcgcagtgcgcgaagtttgcgacttattactcctggcgcagggcaaactggatgaagccaaagggcaatcgatatgagtaaagccagacgttgggttatcattgtgctatcactggcggttctggtgatgatcggcattaatatggccgaaaaagacgataccgcccaggtggtcgtcaacaacaatgatcccacctataaaagcgagcatacggacacgctcgtctataacccagaaggggcactaagctatcgattgattgctcaacacgttgaatattattccgatcaggccgtttcgtggtttacgcagccggtacttaccacgtttgataaggataaaatcccgacatggtccgtaaaagcagataaagccaagctgaccaatgaccggatgctctatttatatggacacgttgaagtcaacgcacttgtgccagactctcaacttcgcagaatcacgacggataacgcgcagatcaatctggtgacgcaggatgttacctctgaagacctcgtcacgttatacggaacaacatttaactccagcggtctgaaaatgcgcggcaacttacgcagcaagaacgccgagctgattgaaaaggttagaacatcctatgaaattcaaaacaaacaaactcagccttaatcttgtgcttgccagctcacttctggccgccagcattccggcatttgccgtaaccggagacactgatcagccgatccacattgaatcggaccagcaatctcttgatatgcaaggcaacgtggttacctttaccggtaatgtcatcgtcacccagggcaccatcaaaattaatgccgacaaagtggtcgttacccgtccgggcggcgaacaaggtaaagaagtgattgacggctacggtaaaccggcaacgttctaccagatgcaggacaacggtaaacccgttgaaggtcacgcttcccagatgcactacgaactggcaaaagattttgtcgttctgacgggtaatgcttatctgcagcaggtcgatagcaacattaagggcgataagatcacttacctggtgaaagagcagaaaatgcaggctttcagcgacaaaggcaagcgcgtaacaaccgttctggtgccgtcgcagctgcaggacaaaaacaacaaaggccagaccccggcacagaagaagggtaattaattcgttatggcaacattaactgcaaagaaccttgcaaaagcctataaaggccgtcgcgtggtagaagacgtcagcctgaccgtcaactccggggaaattgtcggtctgctggggccaaacggtgccggtaagaccaccactttctacatggttgtaggcattgtgccgcgcgatgcgggcaacatcattattgatgatgacgatatcagtctgctgcctctgcatgcacgcgcgcgccgcggtatcggctatctgccacaggaagcctccattttccgtcgcctcagcgtttacgataacctgatggcggtactgcaaattcgtgacgacttgtctgctgaacaacgtgaagaccgcgcgaacgagctgatggaagagtttcacattgagcacctgcgtgacagcatggggcagtcactctccgggggtgaacgtcgccgtgtagaaattgcccgcgcactggctgcgaatccgaaatttattctgctcgacgaaccgtttgccggggttgacccgatctcggttatcgacattaaacgcatcattgagcacctgcgcgacagcggcctgggcgtgctgatcactgaccacaacgtgcgtgaaacactggcggtttgtgaacgcgcttatatcgtcagtcaggggcatttgatcgcccacggcacgcctacagaaatcttacaagacgaacacgttaagcgtgtataccttggggaagacttcagactctgatagggtagaagtttgcgacgttttagcaggagagtacgattctgaacatgaagcaaggtttgcaactcaggcttagccaacaactggcgatgacgccacagctccaacaggcaattcgtctgttgcagttgtcgacgctggaacttcagcaggagctacagcaggcgctggagagtaatccgctgcttgagcaaatcgacactcatgaagaaatcgacacccgcgaaacgcaagacagtgaaacgctggacaccgccgacgcgctcgaacaaaaagagatgccggaagagctgccgctcgatgccagttgggacaccatttacaccgctggtacaccatccggcaccagcggtgactacattgacgacgagctgccggtctaccagggcgaaacgacgcagaccttgcaggattacctgatgtggcaggttgagctgacaccgttttccgacactgaccgcgctattgctacctctatcgtcgatgccgttgatgaaaccggttatctgactgtcccgctggaagatattctcgaaagtataggcgatgaagagatcgacatcgacgaagttgaagccgtccttaagcggatccaacggtttgatccggtcggtgtggcggcaaaagatctgcgtgactgtctgctgatccaactctcccaattcgataagaccacgccgtggctggaagaggccagactgatcattagcgatcatctcgatctgttagccaatcacgacttccgcactttaatgcgcgtcacgcgtctgaaagaagatgtgctgaaagaagccgtcaatctgatccagtcgctcgatccgcgccccgggcagtcgatccagactggcgaacctgagtatgtcattccagatgtgctggtgcgtaagcataacggtcactggacggtagaactcaacagtgacagcattccgcgtctgcaaatcaaccagcactacgcctcgatgtgcaataacgcgcgcaacgatggtgacagccagtttatccgcagcaatctgcaggatgccaaatggttgatcaagagtctggaaagccgtaacgatacgctactgcgcgtgagtcgctgtatcgttgaacagcagcaagccttctttgagcaaggtgaagaatatatgaaaccgatggtactggccgatatcgcccaggctgtcgaaatgcatgaatcgacgatatctcgcgtgaccacgcaaaaatacctgcatagtccacgaggcatttttgaactgaagtatttcttttccagtcacgtcaataccgagggcggcggcgaagcttcctccacggcgattcgtgcgctggtgaagaaattaatcgcggcggaaaacccagcgaaaccgttgagcgacagcaagttaacctctttgctgtcggaacaaggtatcatggtggcacgccgcactgttgcgaagtaccgagagtctttatccattccgccgtcaaaccagcgtaaacaactcgtttgacccaaccgataaggaagacactatgcagctcaacattaccggaaataacgtcgagatcaccgaggcactgcgcgaatttgttacagccaaatttgccaaacttgagcaatattttgaccgaatcaaccaggtctatgttgttctgaaagtggagaaagtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaattgtccgggcaattagcatgtgcatggcggtctgttgtgcggcacaacgggccatttgtacggttaatgctccgagcctgttccactgtttgagtgggcaggttcttaggtgaaattatgacaaataatgatacaactctacagcttagcagtgttcttaacagggaatgtacgcgaagccgcgtccactgtcagagcaaaaaacgcgccctggaaatcatcagcgagctggcggcgaaacaacttagcctgccgcctcaggtggtttttgaagctatcctgacgcgggaaaaaatgggcagtaccggtatcggcaatggtattgccattccgcatggcaaactggaagaagatactctgcgcgccgttggcgttttcgttcagctcgaaacgcctatagctttcgatgccatcgacaaccaaccggtggacttactttttgccctgctggtgccggcagaccaaactaaaacgcacctgcatactctgtcgctggtggcgaaacgtctggcggacaaaaccatctgccgccgtttacgcgcagcccagagcgatgaagagctgtatcaaatcattacggataccgaaggtactccggatgaagcgtagttattcggtaatgtctcttttagacgttgtgaggagaaacagtacatggtactgatgatcgtcagcggacgttcaggttcaggtaaatctgtcgccctgcgtgcgctggaagatatgggtttttactgcgtggataaccttcccgtagtgttgttacccgatctggctcgaaccctggccgatcgcgagatttctgccgccgtcagcattgatgttcgtaatatgccggagtcaccagaaatattcgaacaggcgatgagtaacctgcctgacgctttctcaccgcaactcctgttcctggatgccgaccgtaataccttaattcgtcgttacagtgacacgcgccgactgcatccgctttccagcaaaaacctgtcgctggaaagtgctatcgacaaagaaagcgatttgctggagcctctgcgttcgcgagcggatctgattgtcgatacctcagaaatgtccgttcacgagctggctgaaatgctgcgtacccgtctgctgggtaaacgtgaacgcgaactgaccatggtctttgagtctttcggcttcaaacacggtatccctatcgatgcagattacgtctttgacgtgcgcttcttgccgaacccgcactgggatccgaaactgcgtccaatgacaggtcttgataaacctgtcgccgcgttcctcgaccgccacacagaagtacacaattttatctaccagacgcgaagctatcttgagctatggttacctatgctggaaaccaacaaccgtagctacttgacggtcgccattggttgtaccggcgggaagcaccgttcggtgtatattgcagagcaactggcagactacttccgctcgcgcggtaaaaacgtccagtcacgccatcgtacgctggaaaaacgtaaaccatgaccgtcaagcaaactgttgaaatcacaaacaagctgggcatgcatgcccggcctgcaatgaagctgtttgaattaatgcagggttttgacgctgaagtgctcttacgtaatgacgaaggcaccgaggctgaagccaacagcgttattgcgctgctgatgttggattctgccaaaggacggcagattgaagttgaagcgaccggtccacaggaagaggaagcactggccgccgttatcgccctctttaattctggttttgatgaagattaatcttcatcactttgacatacaactcccttcaaactccccccgacaataagaaaatcacgtactgaaatcgttctcaatcaacgtcatttgtacattttgtgcgcttttcactttcagaagaaccttaagaaaaccttaagaggcattgtttaggttttgtttaagttaatcgaccatactggagatcgtcagaaaatatttccaggagatggcatgattcgcttatctgaacaaagtcccctgggcaccggaagacatcggaaatgttatgcgcatccggaagatgcccaacgctgtatcaagattgtctaccatcgtggcgatggtggcgataaagagatccgccgtgagttaaagtactacgcgcatcttggtcgccggttaaaagactggagtggaataccgcgctatcacggtaccgttgagacggattgcggaaccggttatgtctacgatgtgattgcagattttgacggcaagccttccattacgctgaccgaatttgctgaacaatgccgttacgaagaagacattgcacaactgcgccagctactgaaacagctgaagcgttatttgcaggataaccgtatcgtgacgatgtcgctgaagccgcagaatatcctctgtcaccgcatcagtgagtcagaggttatcccggtcgtctgcgacaacattggtgaaagcacattgattccactggcgacctggtcgaagtggtgttgtctgcgtaagcaagagcggttatggaaacgatttatcgcccaaccggcgctggctattgccctgcagaaagatctgcaacctcgtgagagcaaaacgctggccctcacttcgcgcgaagcttaatccagctggtgttgttgcataaacggctcaccgcctaactgatacatctgccgtaaaatccacgcctgacggctacgcacgtagcccgatggcgaggagactttgaaacgaagtggattaggtaatacagctgccagtaatgcagcttccgaccgggtaagtttgctcgcgggtttgtggaaataacgttgtgccgcagcttcgacgccaaacacaccgtcgccaaattcggcgatattcaggtaaaccgtcaggatacgctttttgctccagaccgtttctatccccagcgttaatccggcttccagcccttttcgaacccagctacgcccatcccataaaaagagatttttggctgtctgttgagaaatcgttgaagcaccgcgaatacggttttcattgcgctcgttgtgcgccagggctttctcaatggaagcgacatcaaagccccagtgctcaggaaatttctgatcttctgcggcaatcaccgccagtcccatccacggcgagatttgatccatactgacccagtcagaatgtgccacgtaacgaaaattgccatgcagccaggcgctgacctgtcgctcgaccattaccgctgagaagggaacaggcgcaacgctaaacaacgcgatgcccccgccccagaaaacggcgaggacaaccattaaccgcaaaagaaaacggcgaacgaaactaaacaccgttaagcggcttttactcattcagccagaaccagcacgcgggaaaccagcttatcaatgccgctcgccgcttctgcaatgttctgcgccagcatatatgctggggtggtgacaatcttattgtcttcatcaaccacgatatcatcgacaggacacggcacatgctccgcgcccatctcttccagcacttctgcggtatcgatatcagtaccgatggtcaaacgcagcgggaaatcgaaaattttcggcagcatcgccggggcaatacacataaaaccaagcggttttccggcctgatgcatcgcttgtgccagcgcctttaattcacggtcaacggtgcattcgctaccaagactggcaaaattgcttaaattcttcgccgcgccaaacccccccggcacaatcaacgcatccagttcagcggcatcggcctgggccagaggacggatttcaccgcgcgttattcgtgccgcttcaatcagcacattgcgcgtttccgtcatcgcttcgccagttaaatggttgataacatcaacctgctgcttatccggtgcaaagcagaccgcctgcgcaccgctgcgtgaaatagctaacaacgtcaacaccgcttcatgaatttcagaaccgtcatagacgccgcatccgctcagaattacgccaattttcttcattgtgatcatcctttcgcaattgactgaaacacattaatttttttaataaaaatggtacgcatcacacatttaactgattcatgtaacaaatcatttaagttttgctatcttaactgcgtgcggcctgaaaaacagtgctgtgcccttgtaactcatcataataatttacggcgcagccaagatttccctggtgttggcgcagtattcgcgcaccccggtctagccggggtcattttttagtggcttttgccacccacgctttcagcacttctacgtcgtgacgccactcttctttcatctcttcaatccattcaccgacgttatcttcccaggccggaaggtcaggagactgaatttgctgacccagctgttgcagatggcgtaaccccactgaccccgccgcacctttaattttatgtccttcctcaacaatgccttttttatcctgcgccgtcagattcgactccagcacgctgacatagcccggcatcatcttctcaaacaccgctaacccgtcggtgatcagcttcggtcctacaagttcgagatactgttccagcatgggaatatcgagcaatgcttctgatttactgttctcttctgtcgtcaccgtactctcctcatcatcctgggtatcccagaatttcttgatcatcgcggttagcgccggaacagaaagcggcttactcagcacatcatccattccagcattgaggtactcttgtttgtctttcagcacgttagcggttaaggccaccagcggcggtaaatcctcgcgcggataacgtttcgtcagttcacgagagatatccagcccggtcatatctggcaactgaatatccagcaacaccaggtcgtattcgcccggtttaaacatctccagcgccgccttgccggtcatggcgacatcaacgctgttacctaatttttccagcacagaacgcgcaacaatcacgttcagttcaatgtcttccaccagcagcacattcagcgccggtaaaggcatatcgtcttcatcaaacgcatcatcgacctcttctgctaccgacggtgcgtggatcgtcaacgtaaaggttgaacctttgccctgttcgctggtaaccgtaatatcgccgcccatatttttcgccagacgacgagaaacggccagaccaataccggtgccggtggcaggtttaccgccatgactgtctttcacctggtaatacatggcgaaaattttatccagctcatcctgcggaatgccgataccagagtcttccacttcaaaatgcagcatatcgccttcatcgtagcgcacgcgcacggtaacctggccttgctgggtgaatttgacggcgttactgatgaggttccacaggatctgccgtaaacgcgtcccgtcggtaatgacctgatgcggtaatggcagcgtcggctccaggttaaagcgcaatcctttttgttgcgcctgcaatgcggagagattttccagatcggcaaggaagctggtgaaatcaaccggttgattatcaagctggaccttgcgccgttccatcttatccatgtcgataatatcgttaaagatattccccagcgtgacggccgaaacatggatggtcttgagatatttttcctgctcggcggtgagttcggtatccagcagaatgcggctcagaccgacgataccgttcagcggtgtacgcaattcgtgactgatggtggagataaacgtcgttttgtcgcggctggcccgttcaagcgcatcctgataccgcttacgctcggtaatgtcgcgaccaaagcccatcaaaccgtgacgtttacccacgcggtcgtagtacggcactttacggatttcaaagcaggctttgcgcccgtccgggtaatccagccactgttcataggtcagtgacacattatgacggaacactttttcatcggtttcaatgacttttgcggcggcttccggtgagtaaacatcagcaggtttcaggtgaaccagttgtttttcgctttttccggtcagcagctccatcgcgcggttacagccggaaaactctttatcttcgttacgataaaaaaccaggtcgggtgaagcatcaaggaaggaacgtaagaatgaggattgctgctcgagctgaatttgtgtctcttcgcgctctttgatttcaattttcagttggccgaaggtttcctgcagttctgcttccgctttttcacgaacggcaatttcctgatttagctgggcaatattatcttttaactgaacgttgaggctcaaatcgcgctcgcgcatctcctccagtttttgcaccagccgtgacagacgttgtcgtgactcctccagttgctcgacgaccaccgatagaaagtagaccgcccacggcgtaatcagcaaaccaaagaagatagaacgaataacatcaatgctttcgacctgaccatgcagcaccatggttaccgccatttgtaccacaatggcaagaacgacgagggccagcgccagcaacattgagaagcgcaccagacctaacttcatcatcaggtcaacataatactgcgccagcagacgaatttgcttcattagggaattccttcacgacaacctgccccaataatacccaattctgacagttacgttataaattgtgtgagaaatgcggaattcccctcaacgacctactccgttggaggtagccacggacgtcccagcgccgatccctgtacgccatgttcattcagatagcgatccagctcgaccattcccgtccatcgattttcgcaccacagcggagcaagcagcgtcgggcgacgggcgctggcggaaatgcggtggtagatcacttccggtggcgtatggcgaatcatttctccggcagtgagcgtgtaatcctccagttcaataccgttcaaacgccccgcttcccaggctttcgccataatgctgcctttcacaatatgcagcggatgcagctttatgccgtccacgccggtttcaaccactcgctccagcgtttgcaaacattcagcctgcccttcgccaggcaggccgacaattaagtgggaacacaccttcagcccgcgctgacgtgccagctgggttgtacgctgataacaggcaaaatcatggccgcggttgatgcgatgcagtgttttgtcgtgggcggtttgtagccccagctccagccacacttcgtaaccctggtccttatattcgcaaagcagatccagcaccgcatccggcacgcagtccgggcgggtacccacacacaaaccgacaatattggcctggctcaccgcctgctgatacatagaacgcagcacctgaacttccgcaaaggtgctggtatacgcctgaaagtaggccagatagcgtttagcgcggttaactaaattcgcctggtgcgccagttgctcggcaatggaacgatgctgctgcgcttcatcggcaaacgaggcaacattacagaatgtgcagccaccacgcccgatggtaccgtcacggttagggcagctaaaaccgccgtgcagcgtcagcttatgcaccttttgcccataacgacgggtgagatcaccaccaaacatattgactaatttctgtaactgcataatctgatagaccgcgccttgaaaagaggccaaagcctgccatttttagctcaattcggcgatgacctggatcaatcgtcccggcctgcttttatcaactgcataatcaatcaaaattaccgaaatttcatgcataatcacataaatcacttttgcttatcttgtgtcagatttttttatctcctgatggattttaggcaaaaacagtagcatgaaacgtcattaccaattaaggcagtataaaatgctggttttgtcgtcagttcaaggcaggataagggttaacacacctttatgacagtcaggaattgactgtttctctaacgacttcccttttagccttaaagataaaatccattttaatttcagtcatttaataaagaattttgcgctaaagcacatttctgtaccaataagcttgccatttgacctgtatcagctttcccgataagttggaaatccgctggaagctttctggatgagcagcctgctcatcatatttatgcagtaattgagatcccctcttcaccgtattaaccgatgcgaaaaggacaacaagggggcgaatgcgaggcgcgcgtatgacacgcaaaccccgtcgccacgctctttctgtgcccgtgcgcagcggttcggaagtggggttcccgcagagcctgggggaggttcacgatatgttgtacgataaatcccttgagagggataactgtggtttcggcctgatcgcccacatagaaggcgaacctagccacaaggtagtgcgtactgcaatacacgcactggcccgcatgcagcaccgtggcgcgattctcgccgatggtaaaaccggcgacggttgcggcttgctgttacaaaaaccggatcgcttttttcgcatcgttgcgcaggagcgcggctggcgtttagcaaaaaactacgctgtcgggatgctcttcctgaataaagatcctgaactcgccgctgccgcacgccgcatcgttgaagaagaactgcaacgcgaaaccttgtcgattgtgggctggcgtgatgtccccactaacgaaggcgtgctgggtgaaatcgccctctcctctctgccacgcattgagcaaatttttgtgaacgccccggcaggctggcgtccacgcgatatggagcgccgtctgtttatcgcccgccgccgcattgaaaagcgtctcgaagccgacaaagacttctacgtctgtagcctgtcgaatctggtgaacatctataaaggtctgtgtatgccgacggatctgccgcgcttttatctggatcttgcggacctgcgtctggaatcggccatttgcctgttccaccagcgcttctccactaacaccgtaccgcgctggccgctggcgcaaccgttccgctatctggcgcataacggtgaaatcaacaccatcaccggtaaccgccaatgggcgcgtgcgcgtacttataaattccagacaccgcttatccctgacctgcacgacgccgcaccgttcgtcaacgaaaccggctctgactccagttcgatggataacatgctggaactgctgctggcaggcgggatggatatcatccgcgccatgcgtctattagtaccacccgcctggcagaacaacccggatatggacccggaactgcgtgccttctttgactttaactccatgcatatggagccgtgggatggcccggcgggcatcgtgatgtccgacggtcgttttgccgcctgtaacctcgaccgtaacggtctgcgtccggcgcgctacgtcatcaccaaagataagctcatcacctgcgcctctgaagtcggtatctgggattaccagcctgacgaagtggtcgaaaaaggccgcgtcgggccaggcgaactgatggttatcgacacccgcagtgggcgtattctgcactcggcagaaaccgatgacgatctgaaaagccgccatccatataaagagtggatggagaaaaacgtccgccgactggtaccgtttgaagatctgcccgatgaagaagtgggtagccgcgaactggacgacgacacgcttgccagctaccagaaacagtttaactacagcgcggaagagctggactccgtaattcgcgtactgggcgaaaacggtcaggaagcggtcggttcgatgggcgatgataccccattcgccgtgctctccagtcagccgcgcattatttacgactacttccgccagcagtttgcccaggtgactaacccgccaatcgacccgctgcgtgaagcgcatgttatgtcgctcgccaccagtatcggtcgtgaaatgaacgtcttttgcgaagcagagggccaggcgcaccgtttaagctttaaatcgccgattctgctctactccgatttcaaacagctcacgacgatgaaagaggagcactaccgcgcagatacgctggatatcacctttgacgtcactaaaaccacgctcgaagcgacagtcaaagagctgtgcgacaaagccgaaaaaatggtacgtagcggcaccgtgctgctggtgctctccgaccggaatatcgctaaagatcgcctgccggttccagccccgatggcggttggcgcgatccagacccgtctggtcgatcaaagcctgcgttgcgatgccaacatcatcgtcgaaaccgccagcgcccgcgatccgcaccacttcgccgtgttgctgggcttcggcgcgacggctatttatccataccttgcctatgaaacgctgggccgcctggtagacacccatgcgattgccaaagattatcgtaccgtgatgctcaactaccgtaacggcatcaacaaaggcttgtacaaaatcatgtccaaaatgggcatctccaccatcgcctcttaccgctgctcgaaactgtttgaagcggtcggtctacacgatgatgtagtgggcctgtgcttccagggggcggtcagccgcattggtggagcaagctttgaagacttccagcaggatctgctgaatctgtcgaaacgtgcctggctggcgcgtaagcccatcagccagggcggtctgctgaaatacgtccacggcggcgaataccacgcctacaacccggacgtggtgcgcacgctgcaacaagcggtacaaagcggcgagtacagcgactatcaggaatacgcgaagctggttaatgagcgtccggcaaccacgctgcgcgatctgctggcaattacgccgggtgaaaacgcggtcaacattgctgatgttgaaccggcaagcgaactgtttaaacgctttgataccgccgcgatgtctatcggcgcgttaagcccggaagcccacgaggcgctggcggaagcgatgaacagcatcggcggtaattcgaactccggtgaaggcggcgaagacccggcgcgctacggcaccaacaaagtgtcgcgcatcaagcaggtggcttccggtcgctttggggttactccggcgtatctggtcaatgccgacgtcattcagattaaagtcgcccagggcgcgaagccaggcgaaggcggtcagttgccgggtgataaagtcacgccttacatcgccaaactgcgctattcggtgcccggagtgacgctgatctccccgccgccgcaccacgatatctactctatcgaggacttagcgcagctcattttcgacctcaagcaggttaacccgaaagcgatgatctccgtgaagctggtttccgaaccgggagtaggcaccatcgcgactggcgtggcaaaagcttatgcggacttgatcaccatcgcaggctatgacggcggcaccggcgcaagtccgctttcatcggtgaaatacgcaggctgtccgtgggagctggggcttgttgaaacccagcaggcgctggttgctaacggcttgcgtcacaagatccgtttgcaggtcgatggcggcctgaaaacgggtgtcgatatcatcaaggcggcgattctcggcgcagaaagcttcggcttcggcactggcccgatggtggcgctcggctgtaaatatctacgtatttgccatctgaacaactgcgcaacgggtgtagcaactcaggatgacaaactgcgtaagaaccactatcacggcctgccattcaaggtgacgaattactttgagtttatcgcccgtgaaacccgcgagctgatggcacagcttggcgtaacacgtctggtggatctgattggtcgcaccgacctgctgaaagagctggacggtttcaccgccaaacagcagaagctggcgctgtcgaagctgctggagactgccgaaccgcatccaggtaaggcactctactgcaccgaaaacaacccgccgtttgataacggcctgctgaacgcgcagttgctgcaacaggcgaaaccgtttgtcgatgagcgccagagcaaaaccttctggttcgatattcgcaacaccgaccgttctgtcggcgcgtcgctttcaggctatatcgcccagacgcacggcgatcaggggctggcagccgatcctatcaaagcgtacttcaacggcaccgcaggccagagcttcggcgtgtggaacgcgggcggcgtggaactgtacctgaccggtgatgccaacgactatgtcggtaaaggcatggcgggcggcttaatcgccattcgtcctccggttggttccgccttccgcagccatgaagcaagcattatcggcaacacctgcctgtatggcgcgaccggtggtcgtctgtatgccgcaggccgcgcgggtgaacgtttcggcgtgcgtaactccggtgctatcaccgtggtagaaggcattggcgacaacggttgtgaatatatgacgggtggtatcgtctgcattctgggtaaaaccggcgttaacttcggtgcgggcatgaccggcggtttcgcttacgttctcgatgaaagcggcgatttccgcaaacgcgttaacccggaactggtcgaggtcttaagcgttgacgctctggcgatccatgaagagcatctgcgtggtcttatcaccgagcatgtgcagcataccggctctcagcgcggtgaagagattctggcgaactggtcaaccttcgccactaaatttgcgctggttaaaccgaagtccagtgatgtaaaagcactgctgggtcaccgtagtcgtagcgcagctgagttgcgcgtgcaggcgcagtaaggggtagcaacaatgagtcagaatgtttatcaatttatcgacctgcagcgcgttgatccgccaaagaaaccgctgaagatccgcaaaattgagtttgttgaaatttacgagccgttttccgaaggccaggccaaagcgcaggctgaccgctgcctgtcgtgcggcaacccatactgcgagtggaaatgcccggtacacaactacatcccgaactggctgaagctcgccaacgaggggcgtatttttgaagcggcggaactgtcgcaccagaccaacaccctgccggaagtttgcggacgagtctgcccgcaagaccgtctgtgcgaaggttcctgcactctgaacgatgagtttggcgcggtgaccatcggcaacattgagcgctatatcaacgataaagcgttcgagatgggctggcgtccggatatgtctggtgtgaaacagaccggtaaaaaagtggcgattatcggcgcaggcccggcaggtctggcgtgtgcggatgtcctgacgcgtaacggcgtaaaagccgttgtcttcgaccgtcatccagaaattggcgggctgctgaccttcggtattccggccttcaagctggaaaaagaggtaatgacgcgtcgccgtgaaatcttcaccggcatgggtattgaattcaaactcaataccgaagtgggccgcgacgtacagctggacgatctgctgagtgattacgatgccgtgttccttggcgtcgggacttatcagtcaatgcgcggcgggctggaaaacgaagacgccgatggcgtgtacgcagcgctgccgttcctcatcgccaacaccaaacagttaatgggctttggtgaaacccgcgacgaaccgttcgtcagcatggaaggcaaacgcgtggtggtccttggcggtggcgacactgcgatggactgcgtgcgtacgtccgtgcgccagggagcgaagcacgttacctgtgcctatcgtcgtgatgaagagaacatgccgggttcccgccgcgaagtgaaaaacgcgcgggaagaaggcgtagagttcaaattcaacgtccagccgctgggtattgaagtgaacggtaacggcaaagtcagcggcgtaaaaatggtgcgtaccgaaatgggcgaaccggacgccaaaggccgtcgccgcgcggagatcgttgcaggttccgaacatatcgttccggcagatgcggtgatcatggcgtttggtttccgtccacacaacatggaatggctggcaaaacacagcgtcgagctggattcacaaggccgcatcatcgccccggaaggcagcgacaacgccttccagaccagcaacccgaaaatctttgctggcggcgatatcgtccgtggttccgatctggtggtgaccgctattgccgaaggtcgtaaggcggcagacggtattatgaactggctggaagtttaagcgaggtaacaatgaattcgccagactgtgtctggcgaatcaaattactgacgaagtgcgcgttgttttctggcaaatgcggcatgagcgtttgacctttcctataatagggataattttcaataaattgtgctttgttcaccaagtctgatgagtgaagcacatcaagcaatttctcatttacaatccgtctcaattacttgttaacacctctgacaataccgattctgcaagctattcagtcttttcattccatgtaaattgtctcgatattaatatacaaaatatgaatataaaaaaccaatatattatccttaattatctatatattttcctatttttcagcgcaaacattcatgtaatgaataattatcaccacaaaccacctcaccagcaccttattattcacatgatcgtaactataaaattcattaaataaatacatcccagcaagttggctatttctgaacgagttatttatttacattcacaaacagatatatatactgcttcagctttttattttaaaaaataaatttgttattaaggatatgttcatatgtttttcaaaaagaacctcacaacagctgctatttgtgcagcactttctgttgcagcattcagtgccatggcaacagattcaactgatacagaattaactatcatcggcgagtatacccctggtgcatgtaccccagttgttacgggcggcggcattgttgactatgggaaacatcataacagtgcgctgaatccgaccggtaaaagtaataaactggttcaactgggccgcaaaaacagcacattaaatataacctgcacagcaccaacgctaattgctgtaacctccaaggataaccgtcagtcgaccattgtagcgttaaacgacacatcctatattgaaaaagcttatgatactctcgtagatatgaagggaacgaaaaacgcctttggtttaggttctgcgcctaatggacaaaaaattggcgctgcatccattggtattgacaggtctaatggtgggattcacgcggcggacgatacaggtgaaattcctgtcgacctgattcaaactgaccactggtcagcagcgacccccacatggaaagcctcatctaatggcgcattctgctcgctgacaagttgctcagcaatcgagcgcggttattctgttgcaaaaacaggggaactgacacctgttgctattacagcggtcaccttcccgttactgattgatgctgcggtaaatgacaatactattcttggttctgatgaaacgatcaaactggatggtaacgtcactatcagcgttcagtatttataagaacttgtaatacagtttttatttttacgcattaaccagttagctataactcggacagattatgccctatgacatggtctgtcttaatcaatctcatcgcaaacagtgcataacatatattaacaatatgtttctgcgttatttatcattattacaggagttttaatttaaatgctcagacacattacattcactgtatttataacaacatcaatgaataccttagccacagggatggttcctgaaacatcagtattgctggttgatgaaaagcgtggtgaagctagtattaatattaagaatacagatgatcatccttcattgctttacaccaccattgttgatttgcctgaaagcaataaatcaattcgtttaatcccgactcagcccgttattcgtgttgaagccggtcaagtacaacaggttcgatttttacttcaggcgactgttcctctgcaatcagaagagctgaaacgcgtaacgttcgaaggtattccaccaaaagatgacaagagcagcagagttactgtttcaattcgtcaggatctacctgtactgatccacccggcttccctgccggaagagcgagagacctggaaattcctggaatggcgtaaaaatggcgaccaaattgagattagcaaccccagtaattatgtcgttcgtatgaccttacaatttaaaacgctcccttcaggaaaaacgggggctataaataagacctattttctaccacacaccagtacaactactgcattaacaaacgctacggatacaaaagtcgagttttacccagccagccgatatggttatcgcggtaataaatatgtcactgacttaaaataactttgcctggagcgacaaggatgttaaaaaaaacgttactggcctacaccattggttttgccttttctcccccagccaatgcagatggtatagagattgccgctgttgattttgatcgggaaacattaaaatcactaggtgtagatcctaatatatcgcattatttttcccgttcagcccgttttttgccaggtgaatattcactgatagtatcagtaaatggcgaaaaaaaaggcaacattgctacgcgctttgatgaaaatggcgacatttgtcttgatcaggcatttctgcaacaagccggtttaaaaattccttctgaagaaaaaaatggctgttacgactatatattgtcctacccgggtaccacaatcacaccattacctaaccaggaagcgttagatattatcgtttcaccacaggcgatcattcccatagggttggatctcacaaacgcagcaactggtggaacagctgcgctgctaaactactctctgatgagcagccgtgcagaattttctaatgggagttcggactactcccaggctgcacttgaaggcgggattaatattaatgactggatgttacgcagccatcagttccttacacaaacaaatggcacattcagtaaccagaactcgtcaacctaccttcaacgtacctttacagatcttaaaacactcatgcgagcaggtgaagttaacctcaataatagcgtgttggaaggagccagtatttacggtatcgaaatcgcaccggacaacgcattgcaaaccagcggcagtggtgtgcaagttactggtatagccaacacctctcaggctcgtgtcgagattcgtcaacaaggagttttaattcattccattctggttcctgcgggcgcattcactatccctgatgtacctgttcgcaatggtaatagtgatcttaatgtcaccgttgtcgaaacagacggtagttcgcacaactatattgttccctccaccctgtttaatcagcatgtagaaagcttccagggttatcgcttcgcgatagggcgggtagacgatgactatgacgaatcaccttgggtaattagtgcatcgagcggatggaatctgacacgctggagtgcaatgaacggcggcgttatcgtagcagaaaattatcaggcggcatcaatccggtcgagtctggttcccctgcccgatttaacagtgagcagccaaattagtacatcgcaggatacgaaagactcactgcaaggacagaaatatcgtcttgacgcgaactacaatctcccattttcacttgggctaacaaccagcctcactcgatctgatcgccattatcgcgaactgtctgaagcgattgatgatgattataccgatccgactaaaagcacttatgcgcttggtttaaactggtctaactccattctgggtggtttcaacatcagtggctataaaacatatagttacgacggtgacaatgactcaagcaaccttaatattaactggaacaaagcgttcaaacacgccacggtttccgtcaactggcagcatcaacttagtgcttcagaaaataatgaagacgatggtgatctgttctacgtcaacatcagtattccatttggcagatcaaacaccgccacactgtatactcgccatgacgatcataaaacccactatggtactggtgtcatgggagtcgtctcagatgagatgtcctactatgtgaatgctgaacgagatcacgacgaacgtgaaacgagcttgaacggcagtatcagttccaatctccattacacccaagtcagccttgccgcaggagcaagcggcagtgatagccgtacttacaacggtacgatgtcaggtggtattgccgtacatgatcagggagtgaccttttcaccgtggactatcaatgacactttcgccatcgcaaaaatggataacaatattgcaggtgtcagaattacatctcaggcaggcccagtatggacagattttcggggtaatgccgtcattccatcaatccagccgtggcgaacatcaggagttgagatcgataccgccagcttgccaaaaaatgtcgatatcggtaacggcacaaaaatgatcaaacaaggccgtggtgcagtagggaaagtcggattcagtgcgataacacaacgccgtgcattactcaatatcacactttccgacggcaaaaaactgcccagaggcgttgcgattgaagatagtgaaggcaactatctgacaacatcagtggatgacggtgttgtattcctcaataacatcaaaccggacatggtgctagatataaaagatgagcagcaatcatgccgtattcaccttacattcccagaagatgcaccaaaagatgtgttctatgagacagcaacaggagagtgccaatgaaacggataataacaggatgcctgctgctgaacttcgccatggccgctcaggcagagtgtaatatctccagtagcatacaaaatatcgactatggcaaacgaagtgctgccatgcgccaagttgaccggggtaaaacaacacaattagcagacagaacaatcacgctggtaatgcaatgcgatcaggacgctcatattcgtgttcagttgaataccgctaatatttccaacaacggatttggatttggcccgaatggttcattaaatctgatcgccagcgatgcattttcaggtagtaacaatctcgacctggcgttagccagtggcaaaaatgacaatccgggcagcacaggaacagcatcaattagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagtacttcccccaataattggctggtgtttatgcaaaatggtcaagaagtggtaattgatagcggtaaaagcgttagcctcacactgacaatggctccagcttttaaggatgaaggggaactaaccgacatgacagatattacaggcaatctgacggtcctggtggaggcaaaatgaacaatgtaaaattactgattgccggaagtgccttttttgccatgtcagcgcaagccgctgatagagtatcaattgacgttaaggtgactctggaagctgcagcttgtactccaatactaagcaacggcggagttgttaacttcggtagtcattcagtcaatagactttcaacgcagcactacacacagattggaacacgtaatattaatatgactataacttgcgaatccgctaccggcattgcgattaccgctcgtgatacacgaatggatagtatgaccaccggaaaagatagtgggggtcagagtggtgtaaaatataccttaaatggcggaggttatattagccagacaacgcgcttattcggcttagggaaaacaaaagataataaaaatatcggtagttatgccgtgttaattgatagcaacaacattagtgccagcaatggtagccagacgttagctgtatcaatagcaggtgcagatgccgtcataacagggcaaaaaagagcatggcaaacgctcaccgcttatccgcttgcagtcgatcaaagctattattacacctttgtaaaaccaggtgaaacaaccccaactcctgtaacgaacgccattataccgcttcaggtgagcgcatctatcgcgaatgatttaggcggttcagaaaaaatcgaacttgatgggaaagctgtgataagcgtagtctacttgtgataacaatgccggacaggagtactatcaggcattcgttttatacgatcggttaatgtttcaggaaagctcttcgcatatcttggggaaagtaaatgtaatacgctgttcttaattgttcagtgctcaccccccagagtatagctcattccattattcaacttagctccatataaagggacagataatggaatcgctctcagaaggaaccacagcaggctaccagcaaatccacgacggtattattcatctggtcgatagcgcccggacggaaacggtacgtagcgttaacgcgttaatgaccgcgacgtaccaggaaattggccgacgaattgtcgaatttgaacaaggtggcgaggccagggctgcgtatggtgcgcagctaatcaagcgactatcaaaggatttatgtctaaggtataagcgtgggttctctgcaaaaaacttacgccaaatgaggcttttttacctcttttttcaacatgttgaaattcaccagacaatgtctggcgaattaacaccattgggaattccgcagacaccgtctgcagaattcccatcggcaaagatttggcagacgctgtctgccaaatctttccccttgcccaggtccacctacgtccgtttactttccgttaaaaacgctgacgcccgcagcttttatgaaaaagagacgctccgctgtggctggtctgttcgccagctagagcggcaaattgcgacccagttttatgagcggacactactgtcacatgacaaatcagccatgctgcaacaacacgctcctgccgagacgcatattcttccgcaacaggcgatacgcgatccctttgtgctcgaatttctggaattgaaagatgaatattcagaatccgattttgaggaggcgctgatcaaccacctgatggatttcatgctggaacttggggatgattttgcctttgttggtcggcagcgaaggttacgcattgatgacaactggtttcgtgtcgatctgctgtttttccaccgccgtttacgctgcctgctaatcgtcgatctaaaagtgggcaaattcagctatagcgatgccggacagatgaatatgtatctcaactacgccaaagagcactggacgctaccggatgaaaatccgcccatcggtctggttctctgtgcagagaaaggagccggagaagcgcattatgctctggcaggtttgcctaacaccgttctggcaagcgaatataagatgcaactacctgatgagaaacgactcgcagatgaactcgttcgaacacaggcggtgctagaggaaggctatagacgccgttaatttcagcggtttcgaattctgcagacagtgtctgcagaatctttaaaacgaactaagttttaagccattaaatcagccttaaccttcaccacaacctttttaatctctccaggctcgccgacaacgcatcctggtttatgcggttcacctggcataaacacggcgaacattcccggttttaagatgatggcttgctcgttatcaatggtgctgcaaagctgataatcatcctcatggtggaactcttcacactgacgcgcagtgcctgccatgccaaacagaatccgttcctcaccgtttaataacagctggatatcaatgtattgctcgtgcaattccgcttttttctcgacgggcgattgagtgttaaacgtcatgacattcataaagatattgtcgccctgtaattcgtaacgacccggcgctttttcttgcggtctggcagctaatgccagcgttaacgcgtcctgtaacgcaggatgtaacccagcagacggtaatgactgtacttcacccatcatcataatttttctccctgggccaacagcgcagccccaagtaaacctgcatcatggcggtaatgcgccgccagtaaatcaacatgaaatgccgctggctcctgcgccagatacgtttccaccagcgccagatacccttctgccagaccaacgctgccaccgaccaccacgcactggcaatcagttgtggctttaatatcagcgatcagccttgcaagcgtacgtgcggagcggtgaatcagctgctgcgcctgctcgtcaccctgcccggcgcgcgtgaaaatagttttcgcatccgcgccagccaactccccctgcgctgccgctgcaatgccgcgaccagaagcaatcgcttccacgcaacctgtgcgtccacagccgcagactgggccgtgtggatcggcaagcgtatgcccgatatgccccgccagaccgccagggccggtaagcagtttgcagccgctcactacaccgccgccaacgccggtggaaacggtgataaagaccatatcggttatatcgccatccagcgcctgaaactccgcccatgctgcggcctgcgcgtcgttaatggcaatggtcggcaaattggtaagttgttccagcgttttgactaacggaaagtgtagcaatccaccaagattatgcggattaagcgccagcaagctgccgtcacggattatcccggtcgaagcgatggcaacccgctgcgcatgagcttgcaacggagagactaatgcggataaggcatcacgcaaggcttctggtgtctggctggctggcgtaggaagttcacgacgatcgcggatctgcccgtcagcgccaatcagcgcggcggcaagtttagtaccgccgatatcaatcgccagtgtggtcatagcaccgcctttttcatcgctgtgttgtaccactgacaaatgtgctcaagacgcgtgattgcagaaccgaccgtcaccgcccacgcgccgtggcgcatcgcatccgccgcctgagcaggcgtgttgtaacgcccttcggcaatcacccgacatccggcgtcgctcaacgttttcaccagcgccagatccggctcttctggcgtttcaggcgtggtatagccagaaagcgtagtgccaataatttcggctcccagcttttggcatgccaggccgtcttccggcgttgagcagtcggtcatcgccagtaaaccgtgatggtgaatacgtgccagcagcgtttcaacaggcaccggacgcgggcggtcggtgccgtcaatggcgataatgtccgcgcccgcctgcgccagcgcatcaacatcttcaatataggccgtgatgcgtaccggagaatcctccagatcgcgtttcacaattccaataatcggcacgctcaccaccgcacgcgtggcttgcagatttgccacaccttcaatgcgaatggcaaccgcgcccgcctgttctgccgctaatgccatggcggcgacgatttcgggtttatcgagcgggctgtccggaaccggctggcaggagacaatcaggccaccgttagcagcgattttttgatccagttgtgcaagtaacgacatacatcttcccttagcgaaaggcccggtacatagaccgggcaacaggattaacttttggttttgactaaatcgtttttggcgctgccaaacggcacggcaccgctgaatggtttaccgtcgatagcgtcatgagtacgcaacgcttccgggcgcaaccaacgctgaacgcgagaaggcatatccagcccaatcagcaggatcaccacgaacgtcagactgaacgagagcgatgccagcgcagtacccagatccagacgttgagcgatcaacgcgccgatgattggggccagtgcaccgcccaatgcgccaacgttgtaggtaaagcccaggcccgctgcacgctggtcggtatcgaaataaccgccaatcagttttggtaagatcccggcgatcccttgtccaagcatttgctggaagaacagtaacagaccgagcacccagacgtttgcgccgccaatcgcaaataccggaataatcagcagctgcgaggccagcaggctacaaacgtacgctttgcgggttcccagccagtcaccgaggaagccacctacgcagcatcccaccgccgcgccaaagccactaaagaacagcacattggctacagtatgcgggttataagccagatcggttttcagatacgttggcagcagcgcctgaatcggccatgagtagaggaaagcaaacaacacgaccaccatcagcattacgcccgttggccagcgtttgcctgcactctgcaccataaagctgataaagattgcggcgcataacagcccaagaacagcgacgatcgcggcattttgcaggttaccggcgaagcagaaccacagcgcagtagccgccgccagtgtcattacgatattggcaatgcgatgttcaccacggtagagaatatccaccattgtgcgtactggtgctttacctgcgtgtttctctttccagtcttccgcttccgggatgtttttacgcagccagagagcaaagatgattggcaaaatgccgataaagaacagcgcacgccagccccagaccggaaccaccaggctatagacctgagcggcaacgacggcccccacagagaagcctgaaatcaaaaaaccactggctttgttacgcagatgttttggccagctttcaatgacataggtggcgctggaaccgtattcacccgccatccccatgccgatgaccagacgagcgataaacatggtgatgtagcctggcgcaaagccgcaggccagcgtcccggccgagaagagaacgatgctggtgaccattgccagacgacgcccgtagcggtcacccatagcgccgagcatcaggccgccgaaccagcgagagataaaggctgcagagatcagacttgccgcctgcaccgtcgtcagcccgaattcaccttgtacttcggtgagtaccagggcgattaaaacgaaatcaaaaccgtcaagcagatatcccaaccaggcagcggaaaatgcgcgccattgtgcacggttgagatggcgataccacgggatattctgggttgtagtactcattgtgagtctcccgcggtgggcgatgcccacacgctttggtatgaaaattgtagggtacagatgcgtttatttcccctcacccggtaggggcgagcgaggggaaacaactcacccgcgctcttgcatcaactgctgggccagcgccttcagttctggcagatatttttcatctaccggtccaaacggtttgcggcacagcggcacagaaacgacatccatataatggaggacagttttcaggccgcggaatacgcccgttttgatcagtaaatcaatgactttattgcattcagtttgcagtttctgcgcggtctggatatcgccttctttcagcgccttaacgatcccctgatagcgccagcccatgatgttgtaggtactgccgataccaccatcagcgcccgccagcagaccagaggcgaagatttcgtcgtaaccgttatagagcacaagatcaggatgttcacgacggatctgctccatctgatagagatcgccagaggtctgtttcagcgcacctacgccaggcaatgtaacaagtgtgttgatctgatccagggtcagttttaccccactcagggctggaatgttgtacaccaccatcggcaaaccatccgccgaatcaataattgcccgatagtgatcgcagtgttcttcaaagctgaaaggatagtagaacggcgtgacggcggagacggcatcgaagccataacgtttagccgatgccgcaagttgttggctttcggcggtgctgacgcaaccgacgtgggcgatgagtttaatcttacctttcgcctcttcggcgacgatttccagtacctgttcacgctcggaaaggctttgtacaaaggcctcgccggtcgaaccacccacgtataaaccgtcgatgccctgctgaatattgaactgaaccaggcgacgcagactcgctttatccagtgcttgttgttggtcaaaaggagtcaggagtgcagccattacgccacgtaaattcgttgccataaatacctctgaagtgatgcttgtctgataaacgatatacctttatacctgttataccagatcaattaagcaacaccccatacagaaagcttataatgcgatctgcttcactaaagtggcattatttctttttgttggtggtctgaccgaaagcgtgccaggtagcagagacgctgttgagatgcgattgcaacgcacgatcggcttcgtcaggatcatgacggcggatcgcatcaacgatcgcaatatgctgttgataactaacgttgttatgttcgtgcagtgcctgatcggtaaccgttgggcgtgcggcaataagccagtcgagcagggcaacgtggatcgccatgaagattgggttaccggggatctccgccagcacgcggtggaaatcaacgtctgaacgaatgaatgccgcgttgttatccagcgactgactgttgatttccagtgcttttgccagcaaatcgatttgctcatcggtggcatgttcagccgcatagcgcaccagactggattcaaagaacagacgtaattgttcgaaatgggcaatcccaccgggatgagaaaggaaatctttcgccatgccggaaagctcaccgatgatagtgtccgcagaaggacgcgagacgcgagcgcgttcgccgttgtttatttgcaccagacctttgcgttttaacgctgccagcgcttcacgcaccgaaggacgcccgacgttaaagaacgccatcagttcgcgttcagacggtaattgttcaccttcgccaaattcacgacggcggatcatctgttccagctcttcttccaccatttcggagagttttttacgcgccagcgggcggctacgcaagttgcgaccaattgcaggtgaagaatcttcggtttgcgaatcaaatgcgttcataaggcccattctgtaaggtcagtgtgattaacatcatcagtgacatcctatcacaggattgaaagtaggggaaaatggcagggttttctctttgtgcctcatcattaccataattaacggaataattaactattgcgaaaaattaatgtaacgcagataaaaacatcccgtttgaattatttataagactattcacgagcattatgaatattatgaatgtgttcttacaaaataatcataagcgcatattttttaatgaaaaatcacctcacctacaattaaaaacacgacatccgcaccataaatagccttgcaaaaaatataacatcgttgttttcaatctgccgtttatgggattgaccgttttcttttgacacggagttcaacaatgttcggcataattatatctgtcatcgtattaattacgatgggctatttgatcctgaaaaactacaaacctcaggtggtgctggctgccgcaggtatcttcctgatgatgtgcggtgtctggttagggttcggtggtgtactcgatcccaccaaaagcagcggctacttgatcgtcgatatttataatgaaatcctgcgcatgctgtccaaccgcattgccggattggggctgtcgattatggcggtgggcggttatgcccgctacatggagcgcataggggccagtcgcgcgatggtgagcttgttaagccgcccgttaaaactcattcgctcgccgtatattattctgtcggcaacttacgtcatcggccaaatcatggcgcagtttattaccagcgcctccggtctgggtatgttgctgatggtcaccttatttccgacgctggtgagtctgggagtaagtcgtctctctgcggtggcagttatcgcaaccacgatgtccattgagtgggggattctggaaacgaactccatttttgctgcccaggtagcgggaatgaaaattgccacatacttcttccactaccagcttccggtcgcctcttgcgtcattatctcggtggcgatctcccactttttcgtgcaacgcgcttttgacaaaaaagataaaaatatcaatcacgaacaggcagagcaaaaagctctcgataatgtcccgccgctctattacgccattttacctgtgatgccgttaatcctgatgctcggctcgctgttcctcgcccacgtcgggctgatgcagtcagaactgcatctggtggtggtgatgttactgagtttgactgtgacgatgtttgttgagttcttccgcaagcataacttgcgcgaaacaatggacgatgtgcaggcgttttttgacggcatgggtacgcagtttgccaacgtggtaacgctggtggtcgcgggtgaaatatttgcgaaaggcttaacgacgattggcactgtcgatgcggttatcaggggggcggagcattctggtctgggcggtattggcgtgatgattattatggcgctggtcattgccatttgtgccattgtgatgggctctggcaatgcgccgtttatgtcatttgccagtcttattccgaatatcgcagccggactacatgtaccagcggttgtaatgattatgccgatgcattttgccacgacgctagcgcgcgcggtttcgccgattactgcggtggtggtcgttacgtcaggaattgcaggcgtttcgccttttgcggtggtgaagcggacagcgatccccatggcagtcggtttcgtggtgaatatgattgccacaatcacgctattttattaagtcattaaaaagacaaaacaggccgcctgggcctgttttgtattacttcacaacgcgtaatgccggtcgaccaccgcgtggtggctgcggaggttcatcgtcaggatgagtgtcatcatcgtgatctggcttgtcgccatcaataaccgacataacggtttcgttgtctgccgatgcctcttcatcattcatgatgctggtatcttcatcgtaggcagcttcaggctcaaacatcgtgcctgcgccattttcacgggcgtagatagccagcacggcagccagcggcacagaaacctgacgcggaatgccaccaaagcgcgcgttaaagcgcacctcatcattcgccagttccagattgccgacagcacgcggcgcaatgttgagtacgatttgcccgtcacgcgcatattccataggaacctgcacgccagggagcgtcacatccaccaccaggtgcggcgtgagctggttatccagcaaccactcatagaatgcacgcagcagatagggacgacgtggtgttagctgtgacaaatccatacagattaactccggcccagacgcatttcacgttctgcttcagttaaagaagcaaggaaagagtcacgctcaaagacgcgggtcatatagcctttcagctctttcgcacccgggccgctgaactcgatgcccagttgcggcagacgccacagcagcggagcaagatagcaatcgaccaggctgaactcatcgctcaggaagtacggcttctgaccgaagaccggcgcaatcgccagcagttcttcgcgcagttgcttacgtgcggcatctgcttcagaagctgaaccgttgatgatggtgttcatcagcgtgtaccagtctttttcgatgcgatgcatgtacagacggctttcaccgcgagctaccgggtaaacaggcatcagtggcggatgcgggaaacgctcatccagatattccataatgatgcgagattcccacagggtcagctcacgatccaccagggtcggaacgctctgattcgggttgaggtcaatcagatcctgaggcggattgtccttttccacgtgttcgatctcgaaacttacacctttctcagccagcacaatgcggacctgatggctatagatgtcagtaggaccggaaaacagcgtcattaccgaacgtttgttggcagcgacagccatgaaaacctccaggtatagtcagaatttttactgctaccagccaccaggtggccagtcagaagttgtgttacccaataaggaacgactctctttgttcgaaaatcaaacaaaaaatgagcaatacccgacatttgggcagaaaattggatgatagtttaccagattttgcgaccattgtggtgagtcgatgccggaaatggggaaaaagagatgcgctttagtctgaaatagttgacttagtcccttattggcgatgtggtttttgttttacctgtctgtcaggtggcagcaaaaagcaactttccagtttttacgctgattcagattttagctataaaaaaacccgccgaagcgggttttttcgaaaattgttttctgccggagcagaagccaattaacgtttggagaactgcggacgacgacgtgctttacgcagaccgactttcttacgttcaacctgacgagcgtcacgagtaacgaagccagctttacgcagttcagaacgcagggactcgtcgtattccatcagagcgcgggtgataccgtgacggatcgcaccagcctgaccagagataccaccacctttaacggtgatgtacaggtccagtttctcaaccatgtcgaccagttccagcggctgacgaactaccatgcgggcagtttcacgaccgaagtactgttccagagaacgttggttgattacgattttaccgttgcccggtttgatgaaaacgcgagctgcggaacttttgcggcgaccagtgccgtagtattgattttcagccattgcctataatcccgattagatgtcaagaacttgcggttgctgtgccgcgtggttgtgctcgttacccgcgtaaactttcagtttacggaacatagcacgacccagcgggccttttggcaacatgcctttaaccgcgatttcaatcacacgctcaggacggcgagcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaataaatagttacacgttggtgaacacccaaacgtcttcaattgttgaggttcacacgacaaagtccggcaaacctaccccttcgaatagcctatgccagcacacaaaaagttttgggaaaaaaactttcttgtaacgtggggtcgcaggattatagagaagtcggggtcaaagatcgacccctttttgtgatttgtgacaggttttaacccgccaaatgctcgcgcttcagatactcttcgctttgcatctcttgcagacgtgacaggcaacgctggaactcaaacttcagccgatcgccctgataaatttcatacagcggcacttctgcactcaccactaatttgacatggcgctcgtaaaactcatccaccagcgcaataaagcgccgcgcttcgctctccatcaaccgcgtcataactggtacatcaaacaacatgaccgtatgaaagagacgtgagagcgcaatatagtcatgctgactgcgggcgtcgacgcacagcgtagtaaaagagaccgccagcgtctggttctcgacgcccattgttgctaatggccgatggttgatttctaacgtcggtgaattttctcgtttcccccccgccagcgccaaccatagtttatccatttgcgcccgggtttcatcgtgaagtggcgaaagccacagatgcgcctgagtgagtgtacgcagacgataatcaacaccagcgtccacgttcattacatcacaatgctgtttaatggcatcgattgcaggcagaaaacgcgcacgttgcaggccatttcgataaagttcatccggcggaatatttgacgtcgctaccagggtaataccgcgagcgaacagggctttcatcagaccgccaagtagcatggcatcggtaatatcagaaacaaaaaattcgtcaaaacagagcacgtcagtttcggctttaaagcgatcggcaataatttccagcggatcggtctgcccctgtaaggcagttagctcttcatgcacccgcagcataaaacggtgaaagtgcaggcgctgtttccgctctcccggcaggctttgatagaaaaggtccatcagccaggttttcccgcgtcctacaccgccccacatatataagccacgcactggcgtatgctttgtgtcttcgcgtttaccccacagcttaccgacccgcgccattagcccactcgtcctgggggctggtggcgtgctattgatgagttcctgataaataatttccaggcggctgacggcctctttttgaacgtcgtcgggttgatggctgccttcattaagcgccttcaggtattgcgatgttggggtaacgctttgcatgatcttattgttattccttgaataatcggtgcgccgttgttcacggttgacgaaaaaaaggccgttctacactacgcgatatgcagtcgggattccacttctgtggaattaacggttatagtggcataatcagccgcaggcatggagcctgaagccaacaccctacggaaacaaaagacaacgggagatgttcatgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcaaaaagctccagcagcctgctgccggaactgtctgctgaagcaaacccgttccgtaatcgtctggcagagtctgaagccagcaacgatcaggcaccggtgcagatgcctcgcgactattctgaaggcgcatccggcctgctgcgtactggcgcgaagcgcgactaatttatttttcgggcgcagccattgcgccctcctcttctctccctccccgactatcatttaatctggtgtctcattgttagccgtctgaaaattcaataacatcaaactgttttgaatctcttttcttatcattcaggtacgagagcaggaataatgaaaaaacaaacccagctgttgagtgcattagcgttaagtgtcgggttaactctctcggcgtcatttcaggccgtcgcgtcgattccaggccaggttgccgatcaggcccctctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccagtaaaggctatgtgctgaccaacaaccatgtgattaatcaggcacagaaaatcagtattcagctcaatgatgggcgcgagtttgatgcaaaactgattggtagcgatgaccagagcgatatcgccctgttacaaattcaaaacccgagcaaattaacgcaaatcgctattgccgactccgataaattgcgcgtcggtgattttgccgtagcggtcggtaacccatttggccttgggcaaaccgccacctctggcattgtttccgcattaggccgcagcgggttgaatcttgaaggtctggaaaactttatccagacagatgcttccattaaccgcggtaactccggcggtgcactattaaaccttaacggtgagttaattggcatcaacactgcaatccttgcgcctggcggcgggagcgtcgggattggatttgccatccccagtaatatggcgcgaacactggcgcagcagcttatcgactttggtgaaatcaaacgcggtttgttaggcatcaaaggcaccgagatgagtgccgatatcgccaaagccttcaaccttgacgtgcagcgtggcgcgtttgtcagcgaagtgttgccaggttctggctcggcaaaagcgggcgtcaaagcgggcgatattattaccagcctcaacggcaaaccgctgaatagctttgctgagttgcgctctcgtatcgcgaccaccgagccgggcacgaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggcggcaaaggtattaaaatcgatgaagttgtcaaaggaagcccagctgctcaggctggcttgcaaaaagacgatgtgatcattggcgtcaaccgcgatcgggtgaactcgattgctgaaatgcgtaaagtgctggcggcaaaaccggccatcatcgccctgcaaattgtacgcggcaatgaaagcatctatctgctgatgcgttaatgtcgtaaaccgggcatcaggcttacgtgtgatgtccggttaactcgtggtatgctgctgccgttcccttttttaatgacgcctccatcatgtttgtgaagctcttacgttccgttgcgattggattaattgtcggcgctattctgctggttgccatgccttcgctgcgcagccttaacccgctttccactccgcaatttgacagtaccgatgagacgcctgccagctataatctggcggttcgccgcgccgcgccagcggtggttaacgtttacaaccgtggtttgaacaccaactctcacaaccagcttgagatccgcaccctgggatccggtgtaatcatggatcaacgcggttatatcatcaccaataaacacgtcatcaacgacgccgatcagatcatcgtcgccttacaggatggacgtgtatttgaagcattgctggtgggatctgactctctaaccgatctggcggtacttaaaattaatgccactggcggtttacctaccattccaattaatgcacgtcgcgtaccgcacattggcgacgtagtactggcgatcggtaacccgtacaacctcgggcagaccattacccaggggattattagtgccacgggtcgaatcggtctgaacccgaccgggcggcaaaacttcctccaaaccgatgcttccattaaccacggtaactctggcggcgcgctggtgaactcgctgggcgaactgatgggcattaatacgctgtcgtttgataagagtaacgatggcgaaacgccggaaggtatcggctttgcgattcctttccagttagcaaccaaaattatggataagctgatccgcgatggtcgcgtgatccgcggctacattggtatcggcggacgtgagatcgcaccactgcacgcgcagggcggtggtatagatcaactgcaagggatcgtggttaatgaagtgtcacctgacggcccggcggcgaatgcgggtattcaggtcaacgatctgattatttcggtggataacaaaccggccatctctgctctggagacgatggatcaggtggcggaaattcgccctggttcggtgatccctgtagtagtgatgcgtgatgataagcagttaacgctgcaggtcaccattcaggaatatccggcaaccaattaagtcgtgcgctcaaaacaaaaaaccggagtctgtgctccggttttttattatccgctaatcaattacttattaacgaactcttcgcccagggcgatatctttcttcagcgtatccagcataccttccagcgcgttctgttcaaatgcgctcagggtaccgatagatttacgctcttccacgccgtttttacccagcagcagcggttgagagaagaaacgggcgtactgaccgtcgccttcaacgtaggcacattcgacaacgccttgttcgccctgcagtgcacgaaccagagacagaccaaaacgtgcagctgcctggcccatagacagggttgcagacccgccaccggccttcgcttcaaccacttcagtacccgcgttctggatgcgtttggtcagatcagccacttcctgctcggtaaaactaacgccaggaacctgtgacagcagcggcagaatggtaacaccagagtgaccgccaataaccggcacttcaacttcgcctggctgtttgcctttcagttccgcaacaaaggtgttggaacgaatgatatccagcgtggtaacgccgaacagtttgtttttgtcataaacaccggcttttttcagcacttcagcagcaattgcaactgtggtgttaaccgggttagtgataataccaatgcacgctttcgggcaggttttcgcaacttgctgtaccaggtttttcacgatgccggcgttaacgttaaacaggtcggaacgatccatacccggtttacgcgctacgcctgcagagataagaacgacatctgcgccttccagcgccggagtcgcatcttcaccagaaaaacctttgattttcacagcagtagggatatggctcagatcgacagccacaccgggagtcactggagcgatatcatacagagagagttctgaacctgaaggcagttgggtttttaacagtagtgcaagcgcctggccaataccgccagcagcgccgaggactgcgactttcatcctaaactccttattatattgataaactaagatatgttgctccgctgccgcgaccttaatccacaaaattgccgtttacaatgaccacatctcaagaatgtgtagtcacgcaagtttagcgtttatgcatttaattgccgtaatcaggaacctaacttacgtaattaacagtcgcttatgcattagcgcaacattccaacaggtggtgacaatataccctaccgttcagccaaaacaacatcaatttgataacaattaatttacttttaagcagaatttgcatgccgtgacgcaggcatgtttctcaataacgaaatttgataaaatcccgctctttcataacattatttcagccttcttcagggctgactgtttgcataaaaattcatctgtatgcacaataatgttgtatcaaccaccatatcgggtgacttatgcgaagctcggctaagcaagaagaactagttaaagcatttaaagcattacttaaagaagagaaatttagctcccagggcgaaatcgtcgccgcgttgcaggagcaaggctttgacaatattaatcagtctaaagtctcgcggatgttgaccaagtttggtgctgtacgtacacgcaatgccaaaatggaaatggtttactgcctgccagctgaactgggtgtaccaaccacctccagtccattgaagaatctggtgctggatatcgactacaacgatgcagttgtcgtgattcataccagccctggcgcggcgcagttaattgctcgcctgctggactcactgggcaaagcagaaggtattctgggcaccatcgctggcgatgacaccatctttaccacccctgctaacggtttcacagtcaaagacctgtacgaagcgattttagagctgttcgaccaggagctttaatctctgccccgtcgtttctgacggcggggaaaatgttgcttatccctctcaaccccctgctttcccctgcgattaatttaacgaatagtgcgttttactgcgacatgtcattcacacaatgaatacataaggtaaaaaaagcacattatgcaaaattcattatctaattgaaaaaactagaattaacgataaataaccgtatttttaattcttttttgttattaaaattcacatttttaacacttagtatcaactgaaacagttagcgcggtattaattagctcaataattagtgtatacttgattttgtgatatgggtcacgaaacaaaggcccagctaaaagattatgtcgaggtaaaaatcatgaaaatcaaaaccactgttgctgcattaagcgtactttctgttctctctttcggtgcattcgctgccgactccattgatgctgcacaagcacaaaatcgtgaagcaatcgggaccgtatccgtaagtggtgtggcgtcttcgccaatggatatgcgtgaaatgctgaacaaaaaagcggaagagaaaggcgcaacggcctaccagattactgaagctcgtagcggtgacacctggcacgctacggctgaactgtacaaataaaccctcatcgtcttgtccgacgatattgcccccggttcgggggcttttttttgcgctaatgacgaacattaaaacgcaaatgcccttccagctcttcctctgcctcatcaaacagcaatattaacgcgccaaaacggcgacgcgttttctctcccagatgaacaaattcaatctcaagtggtagcggcaggacatcgttcattaacacatcccatagtgagtcgagatcgcgtaccttatctttcgccagaccaaaggtttggctaaagtcacgataaaaatcctcctgactctcaatctcatcaaaatcaaaggtataaatattcatctgttgccaccgtcacgtttcgcggcgagttctgccgtgcatcgctaagtatagccatgaaaaaaccgacgcttttggcgtcggttttgacttaactatcggtcaacgcatgttgatacttatggagcatccccgccagccgatttaccggttccgtcacctgcggtggcgcttgccagatgcgtagcttttcctggtagatttccagttcttccagcaactggccaaagtaccgacgacgtttatcatcgctacgggcagatatcacatggtctgctgtgcggcgcatttgtcggtgaaacgccgataaatcctcgttaaccgggatcggtgcatcacgcaggcgctggtgcgcgataatcatcgtcagcgccaggcgaaatttcggcaaatcccctgggaacttattcatcagcaaaaacagctgctgataaagtgccgggaggtggttctctttacgacgtgccacattggtagtcatcgcggaaacagcggcagaaacaaactgattaagcagtacacgtccggtcctgtcgcgcgatttatcccgcaccagcaaaataacggtgaacgcgagcacacagccgacgatttgccctaatgcgctgtcgagaaactgactgaaatggaaagtcatcgggttatccagcacgataatatttatggtgctggccagtgcccccatcgagcccagtcgccgtttctgtacttctataccgaggaagaatcccagcactgccaggctaatgcacagcagcaacatgctctgttgggtattagggataatcaccaaaaagtagagcagccctaacggcagcgcggccagcgtcccgtagataaagtcgatcgccaccatgcgtggattcggcaaacgcattgccagtgacgtcactaccgcaatcatcaccattgcaccactgccggaagtccagcccgtccacagccagaaaagcgtgcccagaatgcaggaaagtgtggttcgccagaagttaaccattgcatgatgacgttcggctgactctacttttacttccggttcgccttgcaggatctcttcttcggtggcgttgatttttgtgttactgataacgccgcgcttgagaagctgataacgcgttgccgccgcgacccagctataaatggtgacaggcgtttcccgttccccggtccaggcgataactctccgcaggcgtttgagctgcttgtggacgtcctgcgcggtttctaccggcgtgtcaaaaaattcgcggaaagtatcagtgatcaattccgggcgcgtattctgaataagataagtttcgcaggattgggtaatcagcgtcagcgatagcgtattgatcgcttttaaacgtcgattggcccgcgcccagcgggaagattccatattcaggttgctgcgcatgccttgtagcgccgtggtgcgtcgcaccaggtcgccccaggctttatcgacaacttcaccatcgccatgcttgatacagagttgcattaattgatattgcgcgaccagcaaactttccagctctcgatccacttcttgtttgatcgatcgcggagaaaagagcaaatccgccataatcgcacacacaataccgataacgatctcgctacaacgttcgacggcaaactgcggcgtaagcaatggttccggctgaatggtgatcacaatgatcagcgcggtataaccggccagcccccacgcatacgagttttctattcgtaccagcgaggatatccaggtacaaaaaccggcccagatacagcacaccagaatcatcaataatggtgcgcggatcatcgcaatgatgatcaccagtccggcaatacagccaataaatgtgccgatgatgcgcaaaaagccacgatagcgaatagcgccagaatacggttcacctcccgcagcaaaggccgtaccggcggcaacaatcgccgctgtcagtaccgcccagcgtggcgtttccagctggaagtgaaagccaacaaacagcgccagtacaatggcggtcgccagttttaccgcaaagcgaatatgttggttagcaatggagaaaatacccatcgtgattaaccaaactcacgcaggcgatgggccattttacggaagaacgaatcctggctttcgtcgcgatcttgtttgccagtgaccaccactgtagcagtggtgcccgcaggccagatgttctcttgctggttgtcgagacgaatacgaaccggaacacgttgcgcaagacgcacccattcaaggttagagtctatagtcgccatccctttgtcgtcacgcgtgctgctggcgttggtgacccctgcggcaacactatcaacagtccctttcagcactttgttactgccaagcggcgtgatctctgcacgataccccggacgcaccccttccagcttagtttcttccatataggccagtacatagaaggagttctgtttcaccagcgcaaccgccgttgatcctcgagtaataaactcaccggtatagacgttgaggttggtcacccagccatctgctggcgcgcggatcaccgtgcgttcaagatccagttttgccagatcgcgggtcgcctgcgctttcgctaactgatgcagaaccgtttgtagtacgttgttggcctggtcgatctcttcgcgagacatcgcctgcacaccgagacggttacgacgtccggcctcctggcgtttctcctgtgccagtacctgataataagcaacatcggcttgcgcttcctcaagcgccttttgatagcgcggctggtcgatggtgaacagtatctgtccttttttcaccagctggttatcatgaacattcacctgggtaatgagtccagaaacgtccggcgcgatcgcaacgacgtcagcgctaaagcgcgcgtcacgcgtccagggggattcggtgtaatagacccaggcattaaaaattgcgatgaaggccagaatgactaatacgaccgtgatggccgtacgggagaattttcttattagtgttttcacttcaacctcaaacgaacagtcgcgatatcaaataaaacaagcagcaatagagcgcggtgttgaacaacgccggatgccagacaaagtcgtagatacctgttggcacaagtacccggcgcaccagccagaaaatcgccagtgataaaagcaattcaaaaaatatcggtgggaaggacagcccaaacaccacgataacgggaaacagactcatgttgaccttggttgtaaagagagagcaggcgttattattttcagcatctgtcgccgcagagaagggcatggaaagccgggcgagagcaacattgctgtagattgatatttaatatattagcgtaactgttatgctgttatctatattatgtgatctaaatcacttttaagtcagagtgaataatggaacgactaaaacgcatgtcggtgtttgccaaagtagttgaatttggctcttttaccgccgccgccagacagctacagatgagcgtttcgtccatcagtcagacggtatcaaaactggaagatgagttgcaggtaaagctgttaaaccgtagcacacgcagcattggcctgaccgaagccggtagaatttactaccagggctgccgtcgtatgcttcatgaagtgcaggatgttcatgagcaactgtatgccttcaataacacccccatcgggacgctacgcattggctgttcttcaactatggcacaaaatgttctcgccgggctgacagccaaaatgctgaaagaatacccaggtttgagcgtcaatctggttaccggaattccagcccccgacctgattgccgacggtctggatgtggtgatccgcgtcggcgcgttgcaggattccagcctgttttcccgccgtctgggcgcgatgccaatggtggtgtgcgccgcgaaaagctatctcacacaatacggcataccggaaaaacccgccgatttgagtagtcattcatggcttgaatacagcgtgcggcccgacaatgaatttgaactgatcgcaccggaagggatctcgactcgcctgatcccacaaggaagatttgtgactaatgatccgatgacgctggtgcgctggctgacggcgggtgccgggatcgcctacgtgccgctgatgtgggtgatcaacgagatcaatcgtggggagctggagatcctgctgccgcgttaccagtcagatccacgcccggtttatgcgttatataccgaaaaagataagctgccgctgaaggtacaggtcgtgatcaactcgctgacggattattttgttgaggtcggtaaattgtttcaggagatgcacgggcgcgggaaagagaagtaattcatattgtactgttacgttgtacaaacctgtgccaacgggttcccctcaccctaaccctcaccccaaaggggcgaggggaccgttcgtgcacgtagaaagattaattatccttctgaaaatagtgaaattattacgcagtaccgccaacagtcaggttatcgactttcaacgttggctggcccacgccaaccggcaaactttgcccttctttaccgcagacacccacgccgttatccagtttcaggtcgttgccaaccatcgaaatctgctgcatggtttcgataccggaaccaatcaacgttgcgcctttcaccggcttcgttactttaccgttttcaatcagatatgcttctgaagtggagaaaacgaatttgccggaggtgatatccacctgaccgccaccaaagttcggtgcatagataccgtactcaacggattcaataatttcctgcggggtcgatttacccggcagcatataggtgttggtcatacgcggcatgggcagatgggcgtaggattcacggcgaccgttgccagtcggcgtcatccccatcaaacgcgcgttgagtttatcctgcatgtagcctttcagaatgccgttctcaatcagcacgttgtactggcctggcgtaccttcgtcatcaatcgccaccgaacctcggcgatcgaccatcgtgccatcatcaaccacggtacacagttctgaagccaccagctccccgacctgtccactaaatactgaagtgccacggcggttgaagtcgccttccagaccgtgaccaaccgcttcatgcaacagcacgcccggccaacctgcgccaagtactaccggcatggtgcccgctggtgcagcaacggcagaaagattgaccagcgccatacgcactgcttcttttgcccatgcatccgcacggacttcgccgtcgagatcggcaaggaagaattcataaccaaaacgaccgccgccgccactggcaccgcgttcgcgtttgccatcttcttcgacgagaacgctcacggaaagacgcaccagcggacggacatccgccgctagcgtgccgtcggtggccgcaaccaaaattaattcatagacaccactgaggctggcagtcacttcctgtacgcgcttgtccgcttcgcgggcaaccttatcgacgcgacgcaggatatccagcttctcttcacggctcatgctttgcagcggatctaccgaggtatacaacgggctatgctctaccgcgcccagcgtctgtactttaccatcaccactatcacggacgatggtgcgcgccgcttgcgcactctgttccagcgccagcaggctgatttggtcagcgtaagcaaatccggttttttcaccgctgattgcacgcacaccaacgccctgatcgatgttgtaagaaccatctttaataatgcggtcttctaaaacccaggattcgtgatagctcgactgaaaatagagatcgccataatcaaggcgacgttcggccagttgaccgaggatcgcgaacaagtcctgatgtttcaggccgttcgccgctagcaattgttcacttaccaggttaagactcatcgtttttgctactcgttagttactgcagtagaggattttttacggctgccggatgcggcgtgaacgccctatccagcctacggttatgttccggtttgtaggcctgataagacgcacagcgtcgcatcaggcaacggctgtcggatgcggcgtaaacgccttatccgacctacggttatgttccgtttgtaggcctgataagacgcacagcgtcgcatcaggcaacggctgccggatgcggcgtaaacgccttatccgacctacggttatgttccgtttgtaggcctgataagacgcacagcgtcgcatcaggcaacggctgccggatgcggcgtgaacgccctatccgacctacggttatgttctggctcgttggcctttggcaacgattatcctatgagattggggcaattacgcgccctcgtcaaatcattgcgctttttctttacgcggttggcgcaacacttcgttgatttgcggatcgtccagcggacccgaaatgtgatagcgcaaaatggagactttgctccacagcggccccagcactttactggcggcaaacactgccgcgccaacaatggggttaaccgcaaaagccgcagccacgcccaccgtcgcagaaatctctggtgcgacaaccgcttccatattcaggtcgcgacgtaccagatttaccgaccctttcatggcgatatccgcctccaggccatccaccagcgtgtcgtcggtgtgcataacgccgtctttaatccacgcggtgctgcgaatggagtcaaaatagaacccttcgccaaaagtgtctctgaaatcaaaacgcagcttacgcatcagggcatctacgctcaataagcgcagcaattgcccggcatgtccggtattgatttcggtaatttcgcctttacccagttgagtatgaatgatgccattcaacgtcgcttcatctggctgccagggtgctttgcgccagtgtaaatcgtaatccacattaaatgacgactggcgtatgggcgtcgtgacaccaaaaaattctgcggcggcatcaattttctgcccgcgcagttttcctttcagcgaggtacgttcattccccggattattaacccattcaccatcggcagtaagccgcgagaaaccagtatcaatcagtccattggtcagcgttaacgtatcgccagaaatggtgatatcactgtcaatgcgaccgaatttttgcccccagaaccagcactctgtgcatcgtatttgggcgtccggccagccacggaagttaatgcgctccgttgtcgggaaaggtgatgacggcgttgaatcaccacgagttttcgccacgctcgggttgtaataaagatatttgatattcgccagccacggcgcgttattacgcatcgctagcgtggcgttgatttcacgcccttgcgcttcaaccagggtgccatttgccgtcggttgcgaaacaatactcaggttattccattgctgatttcccagtgacaacataggcgtacgtaacgttatgtgttgtgggaaactcgctgcaccaccgacactctccgcagcgcctttctggaacagggccagccactcggcaccattcatcggcggcatattgagttcaacgccactttgttccggcaacggcgggagcgttttactgtctgccgcccaaatagcacgatcgagcgtcagcttttgaccgagcaaccagcggctattgaaatgattatccgcaccagcctgtccggttaattcaaagctgttgagattgccatcaaccttaacgtttaccgctagtggttcacccgcaggtttggctaacggtgaaggtaagtgactgctcacattctttagatcgccgttcagctctatgttataggtcgcaccagcatgataaggcagatcaatgcccactttaccatcccacgccacgctgccactcaatgcttcgttcaccgcttcaggcagaacgccggttttcgccggttgccagttaccgttgaggtttaccgctacctggtaggcttttgccccttctttggtggaaaaatccacgttcaacggctgattaaaccagcttgctgtcagtggttcactttgcagatcgctattgataaagctgaatttaccgctcaaatttttcagggtgctgtcgagtggtttgataaacagactgttattacgcagcgtcacttcacctttcgcggttaccagttcgccgttcagcgggatatcaagatgtaagcgagcattcacatcgccgtcgagctggagttcttgcagggtcgcacccagagaatctttcagcggtgtctcatcaaagtaagggccaacggctttacccggacctttaatgtcagcgtcaatcagcagtttttcttttgagtagtcagggatcactgcggtaagattactcgcgcgcacgccgcccagattaacgccatcggttttcatccataaaccgtcgttaataaagtccagttcaatatcaaggttagttaatgcaggccagtccggctggaaggcaaacttcgcgttgcgcagcggcaccagcacttcaaactgaccttcgttgtgtttataggggaagagttgcggattgccaccataaaccagcgtcgcgttatccgcttcaccgccctgaatcgcgccacttaagtaatcaaccaggtctttacccatcaagttttccgggaaatagcgccaggcttgtgaaccatcatcggtactgatgccagccagaatacccagccagggttcatcgttagcaggttgcaggtaacgaaaaccgccgcgcgcatggacggctttggctttaacgtcaatattacgcccatccagctggaaacctttgttattgttcagccagcttatagttgcctggccgtcggcgatttctagtggcgcacggaataccgtttcgtaaggcatctttgcctgcttcatcgacgcggtaagcaaaccattttcaacgctgccggaaagcgtcccggagaagtgttccgcacccggtaataatttccattgcttccaggccagatcgctccacgatgcctgaaaacgggtcttgtctgccgcctgaagcgggatatccagcgccagagtgttaatcttgccgctcggttgtgtggagcgccaaacatcacccagtgcaggtgaaagtttcgcggccagcgggcgtatgccctccaggcctgccagctccagattactggcgcgaatccggagttcgtcactgcgtttattgtctttgccgccaacgtcctgttccggtatccaggccagcgtcaatgctccgctcggccagggtttgccgtccatcgtgatccgtgtatcgggaatagagaactgccagcccggattttcacgcgtaatatgcgcggtcagattatccaccgacagcgtatgcgtttgcttctcgcccaaccagctggcaccgccctgtttcagccagacgtcaccgccggttacatcgcctttgtcgatcgtcatccagccttcaagggagaactgtgccgtttccagcgcaatattgtcctgcatccatttaccgagccacggcttcaggtcgatgtcatccgcctggagccagacgcgaccattgcttaacaacccctcatcatcgcgcaaatccatgcgcacctgcatcacgccgtgctgtccggtaaggctggagaggcttaccaggccttccgcacggtgtcgacgtggatcgttcagccaggtgagttgtgggatcgccagctcggcgcgctgaccggatggcgtcaggaaactgacttcactgtcgcgaagatcgaaatggtcaaattgacgaagaaacagatcgctgatgtgactggcttccagactgtcatcactaccaccgctggtgataggagtgttggtgcgaaagcgcagctgccagaaagtgaggtcgcgaaactgccagcgcatatgtaacaggctctgccagacatccagcgccagagtaacgcgtttaaccgaaaattcgccgccatcttttagttctgcacggatgtcgtgtgcttcaagcgtcgggccaaaattctgccagctggctgagagctgactggcttctaccggcatgccagtcgcggattctattttgttgaggatttccggacgccaggcgtcaagatgcggtaaagcaatacgcaggccgctaaccagcagggcagcgatcacaacgagcgcggctccagtaagcagtaaaatccccggcaatcgcctcacccgtcactccttgtctgctaaaaatgtgactcaaaaaccctttgccggatggcggcccagcatctgtttacatcattacgacgtcaaactgctcctggttatagagcggttcaatttgtactttaacctgtttgccaacgaaaatttccacttccgccagcgagtgtgactcttcgcctttcaaggcttcagctactgccggagaagcatagaccaggaaacggtcggagtcgtaagcatggtggacacgaacaatctcgcgcatgatttcatagcataccgtttccacggttttcaccgttccgcgaccgtggcaggttgggcattcgttacacagtacgtgctcaatgctttcgcgggtgcgtttacgcgtcatctccaccagccccagcgccgaaaaaccattaacgctggttttcacccggtctttgctcaacgcctgctccagcgagtgcagcactcggcggcggtgatcttcattattcatatcgatgaaatcaataatgataatcccgcccagattacgcaaccgtaactggcgagcgatagcctgcgtcgcttcaatattggtattgaaaatggtgtcgtccagattgcgatgaccgacaaacgctccggtattgatgtccacggtggtcatcgcttcggtctggtcgataatgagataaccaccggatttcagttctactttgcgttccagcgctcgctggatttcgttttcgacatcaaagagatcgaaaatcggctggcgtcctgtgtaatgctccagcttgcttgtcatctcgggaatgtactccgaggtgaactcaagtaacgcttcgtaagtcaggcgtgagtcaacgcgaatgcggtccagttcggcatcggcgaaatcacgcagaacacgctgcgccagcgccagttcgccgtacagctgataacgggtctgcgggcgttttttacgctccataactttggtccagacgcgtttcagataagcggcatcggaggccagttcagcctcgccaaccccttccgctgcggtacggatgataaacccgccctgctcgtcgcaatactctgcgaccacttttttcaggcgttcacgttctgattcgctttcaatacgttgggaaaccccaacgtgagaagcccctggcataaacaccagatagcgagaagggagcgtgatatcggtggtcaggcgcgcacctttagtgccaagcggatctttcaccacctgcaccatcagatcttgcccctgacgaaccagttccgagatgtcgcgcaccgtgaattgcttttgttcttcacccgccacacattcggtgtgcggcatgatgtcggatgcatgaagaaacgcggctttatccagcccaatatctacaaaagccgcctgcatacccggaagtacacgacttacacgacccttgtagatattgcctactattccgcgtcgcgcctcacgttcaatatgaatttcctgcagaataccgccatcaatatacgccactcgcgtttccgaaggcgttacgtttactaacaattcagccgtcatgtttatcccttttctcacgcagtgcgttaaaattacttaataattcatacgtttcaaccagcggtaagccgactacggcgtgatagctgccatttatcttcctgacaaaacagccacccagcccctgaataccgtatgcacctgctttatctaacggttcatcgctggcgacatagcccgcgatgtcttcgtctgttaacgttctgaaagtcacatcggtgaccaccaggcaatcgagaatgtgctggctgtcggccaacgccactgctgtcatcacctgatgggtctgacccgataatttgcgcaacatctgcgccgcatgctctgcgtcgcgcggtttctccagcacttctccgttcaggataacgatagtatccgcacccagcaccgggagatccttcgccgtttgcgcgacacctgcccgtgctttctcgcgcgccagacgcacaacatactgctgcgcgctctcctgcggctgacgctgctcctcaatgcccgtaacaatacgttcaaaggtcacgccaagttgcgcaagtaactcctgacgacgcggagaaccggaagctaaatacagagaagtcatagaaacctttattgcactgcaaactgctgacggactttgcgcatcagcaagaaaatccacggccagagcaccccattgactacactactccagaacacttccggtctgaaagagacgttaatcactaaaaactctgcccagaaaacaataatatccaccaccagcgaaagcaacatgacgaccagcgcctgctgccataatgcgaggttgcggaaaagctggtatttcagcgccaccaggtaagcaatgatgctcatcgccaatacgcgtacgccaagcgtcgagccgctgatcagatccagtatggcacccatcacaaaacctgtgcccacatttacgcgatgaggcaaggccaggatccaatacaacaagatgagtaacacccagtttggccggaaaacaatcaggttatccggccagggcatgatttgcagcaacagcgcaatgaggaaagagagccagattacccagcgtccctggctacgatagctcgccactattgccctcccggcgcacgcgcaggcggttgagcaccactttgcggcggcgtagccctttgtggagagcgattagcagcaggctgtgtcggcgcagcaggcgcagtagctgcatttcctgtcgccggttgctgcggagtcggctgagcgatccccgttgccggttcaggtaactttggccccatcgcgtctggcgaaggcaatacctgcggcatcatctgcatcagacgttcattagcaacacgatgcacctcttccggcgtcatcgggttagcgccgttacgatctgccccccacagcagcagcagataacgcaaacgttgcagccctgcagtcggacgcgcctgaatcacagtataagcgcgctgggtatcgagttttacggaagagacaaccgcgaccggatagccttccgggaaacgaccgcccagaccggaagtcaccagcacatcaccaacacgaatatccgtattcgccggcagatgctcaagctgcaaatcatccgtacaaccgttaccggctgcaattacgcggatatcgttgcgcagcacctggattggcagcgcgtgggtcgcatcacaaatcagcagcacgcgactggtcagtttagcgacggccaccacctgaccaacaacacctttgtcgctgatgaccggctggccttcataaacgccattaacgctacctttatcgataacaacttgatcgctataaggatcgttaaccgtggagataacctgagtcaccattttctgctcatcctgacgcagcggggaacccagcagctcgcgcagacgcgcgttctcctgtttgtattgtccaagcatcagcagttcactgtttttcagcaacagttcctgacgtaacgcccggttttcaagttctaattggtcacgcgaggccagcgtctgcgatacgccatccagcaattcacgaggagcattggaaacaaagtagaaaggactgacggcggtatccatataagtacggatttgactgaacgtccccaggcggctgtcggcaataataatgccgagcgccaccagcaccgccagaataaggcgaatctgtagcgacgggccacggctaaaaattggcttcataagttatgcgtattctcgtatcagaccaggcagggtaaacagacacttcccctgcctgcatccgattactcttcgctgaacaggtcgccgccgtgcatgtcgatcatttccagcgctttgccgccaccgcgcgccacacaggtcagcgggtcttcagcaacaacgactggaatgccggtttcttccattaacaaacggtcaaggttacgcagcagtgcgccaccaccggtgagcaccatgccgcgctcggagatgtcggaagccagttccggcgggcactgttccagtgcaaccattaccgcgctcacaataccggtcagcggttcctgcagtgcttcgaggatttcattggagttcagggtaaaaccgcgtggaacaccttctgccaggttacggccacgaacttcgatttcacggacttcatcgcccggataagccgaaccgatttcgtgcttgatacgttctgcggtggcttcaccgatcagagaaccgtaattacgacgcacatagttgatgatagcttcgtcgaaacggtcaccaccaatgcgcacagaagaggagtaaaccacaccgttcaaggagataacagcaacttcagtggtaccaccaccgatatcaaccaccatagaaccggtcgcttcagaaaccggcaggccagcaccaattgcggcagccatcggttcttcaatcaggaagacttcacgggcaccagcgccctgcgcggattcacgaattgcgcggcgttcaacctgggtcgcgccaaccggcacacaaaccagaacgcgcgggcttggacgcataaagctgttgctgtgcacttgtttgatgaagtgctggagcattttttcagtcacgaagaagtcggcgataacgccgtctttcattgggcgaatggcagcaatattgcccggcgtacggcccagcatctgcttcgcgtcatgacctactgcagctacgcttttcggtgaaccggcacgatcctgacgaatggccaccacggaaggctcattcaatacgatgccttgtccttttacataaatgagggtattcgcagtacccaggtcaatggacaagtcattggaaaacatgccacgaaattttttcaacatactaagggataatcctgaaagctggggcggaaaagaaaatccgcttactttaccaaccacacgcagcagcgacaaggcgcaaaaatcatctgctacggtgaaaattagtgcagttcgtttcctttgttacaaatctctgcctgagtccagaaaggcttaatgcatcagcagcattcctcgcctgtttgcaaccgcgtaaggtcattcatctgcatatgtgctgcaacaatctggcgagcagacaagcacactcccatgagacgcagcgcgcattattctacgtgaaaacggattaaacggcaggttaaaccgagtatctttgtgaatattttttcacgttagtatcaagtggctgtgaggacgcgaaaaaatccccttgcccgcctgtaacaccgcgctgaatcagggtctgccactcgcttcgcgaacgcacgccggtggcgtaaacctgggtgctggtcccggagcaggcttccaccaggctttgaaccagcagctggttctccgttcgcttctcaatgtttctgaccagccccggatggagcttgagtaactcaacattaagttctttgatccaactggtacttaccagcgtcaaaccagcctggttgacggctacccgtacccctaaagcattcactaaacgaataacaggttgtaaacgactgatatgttgacctacatcggcctctgcaagttcaataattatgcgttttcgttgtgatttttcacattgcattaacgtatcgcgcagccaacgctgaaaacgcgggcgaatcagcgactcaacggtaacctgaatcgccagattttcctctggccagtaacgcaatagtggaataagacggctgatttgcagacggtcatactcttccgataagccaaactgcaagaccatcggcatatactccgccgagctaacctcttcattaccatcgaagatgcggcacatgagttcgcgatgatgaacctgaccttcgcgagtaaccgccggtttttgataaaggcgcgggccgccgcgactgagcatttgctcgataagcgtacgccagcgaacattaccgcgtcctttttcaggcaacgagtcatcgtaaatagcccagctattgccgccctgcaatcccgcattacgcgtggcagactctgcatgttccattacctgctcggtatcctgaccactacgccaggcgcagataccaatgtggatcatatcgtcgcgatcgagcattttattgttcggcaaggtatcaacggctttgattaactgaccggcgatgctctctgcctcttttaacgtccggtgcggtaacagcgcagcaaaatcactgcggtggtaacgcgccagcagtgcgccagggtagcgcatcataaatgtcgacagcagattcgtcagagtgaagaactgttcttcaacctggctgtgcccccaggtatcgctcaacatattgaaatccggcagacgaatcatcatcacgatcccgtgggtacctactttctcctgatcttccagtaacgttgctaactgattatcgaaaaagagtcggttattgaggccggttttcacgtcctgggcggcataagagcggatcagcgtatcaagacggctgtgttgttcgcgtgcgttctgaatttcacgaagcagcgtatccagcgcactgctggttctgggcggccattcatagatggttcccaacacattagagccacgctcaccgtttaagatacgagtagcccgggtttccagcaattcttgcccggcaagttgccgttgtaaccagcgtaccgccaggaagagcataacaatgataaagccaatcgcccccgtgagcggcgcggtggtcatcaacgaatggaaatagttgcccatcggatcctgataaaccagacgcaacgacatccccggatgctttatcaacggaacgctcagttcgcgaaacagatcgctggagccaactggacgataactaccatttctggccagggtataaacctgtttatcaccatggagcaggtctacacgaacgatatctgccgacatcattaattcggtaatttgtggccttaatacgctgaagtcattcgacacaaggtgggtatcaatcgccgtcgccaccgcctgaacgcgatgactaaacttatactgaatggcgttgtagaaacttagcgaacagcccagcaaagtcacaaaaattgttaacccggtgagcagcgtaacaaaggccgaaaatttcgtcgttaatctcatccttgtgttaactccgatagtgaggaagcgggcatactagcaaatcagatttatctcgcaatttattgcgcttcatcggctttgcttttccattagcgagtatagtcttcagaaattattttccaatccatcatgcacatgaggaccacttatgcaggcgttacttttagaacagcaggacggcaaaactctcgcatcagtacagactctggacgaaagtcgcctgccggagggcgatgtcacggtcgatgttcactggtcgagcctgaactataaagatgcgctggcgattaccggtaagggaaaaatcatccgtaattttccgatgattcctgggatcgattttgccggaactgtacgcaccagcgaagatccgcgttttcatgccggtcaggaggtgttactcactggctggggcgttggtgaaaaccactggggtgggctggcggagcaggcgcgagtgaaaggtgactggctggttgccatgccgcaagggctggacgcgcgtaaagcaatgattatcggtactgccggttttaccgccatgctgtgtgtgatggcgctggaagatgccggtgttcgcccgcaggacggggagattgtcgtgacgggtgccagtggtggcgtcggcagtaccgccgtggcgctgctgcataagttgggttatcaggtcgttgccgtttccggtcgcgaaagtacccatgaatatctgaaaagtttaggtgctagccgtgttctccctcgtgatgagtttgccgaatcccgtcctctggaaaaacaagtctgggctggggcaattgacaccgttggcgacaaagtgctggcaaaagtgctggcgcaaatgaattacggcggctgcgtggcggcctgtggtctggcgggtggttttactctgccaaccacggtcatgccatttattctgcgtaatgtccgtttgcaaggggtggattcagtaatgacgccaccagaacgccgcgcacaagcctggcagcgactggtcgccgatttaccggaatcattctatacccaggcggcaaaagagatatctctgtcagaggcaccgaactttgccgaggccatcattaataaccagatccagggtcgcacgctggtgaaggttaactaaccatttagcagggaataataagagagggaactcattttgaaatcattattcaatcggttaacgggaaaagcggttagccggacagctttcgtcgaacaccttggtcaggaagttatacaacatcatccaaactggaaagtcatgatttcgactgaccacaaattgatgcgcattgatactccactaaacagctattattgatacgcctccgtcgcctgttaggtttatgttgctttgcctgggcgacgctacgcttagccccttacttatttctggtaccatggggtgaataatctgattttgtttgactacaaattaatcactcgaacctatttaatgctgagcattgtcaatcggttaattttgcgtgctttagcattcacatctatccagacgatgcagtgaaaattgggtaatccccagcaaccgctgcgtaatgtcgtctatcttgtcgcgatcctggcatccctacattatttgtggtctgtgaagattatctcattgcagcccctcatcttcgcagggctggcttttcagcttttcaccttacgttataagaagttccgtcgatgatggcgctaatttcgtgaattgtgcggcttgttgcaaattacacggtgttgaaggttatttacatgttagctgttgattatcttccctgataagaccagtatttagctgccaattgctacgaaatcgttataatgtgcgacctcgtcctccctgacgcagtttttgcgctgcggaaaaggtgacattggcgcaacgaaggtatattttgttttttgccggaggatagcagcagatcgctgcacaatgtccgtcaagtctaacattgacactctggggcaaaatagaccggcgtcccggcctgctggaatttatcgctatgcatacagctgtcggggcatacgctttacagacggcggtgaaacgcctgtcacaatcacactaaacaaagagtacggaacccactcatggatattcgtaagattaaaaaactgatcgagctggttgaagaatcaggcatctccgaactggaaatttctgaaggcgaagagtcagtacgcattagccgtgcagctcctgccgcaagtttccctgtgatgcaacaagcttacgctgcaccaatgatgcagcagccagctcaatctaacgcagccgctccggcgaccgttccttccatggaagcgccagcagcagcggaaatcagtggtcacatcgtacgttccccgatggttggtactttctaccgcaccccaagcccggacgcaaaagcgttcatcgaagtgggtcagaaagtcaacgtgggcgataccctgtgcatcgttgaagccatgaaaatgatgaaccagatcgaagcggacaaatccggtaccgtgaaagcaattctggtcgaaagtggacaaccggtagaatttgacgagccgctggtcgtcatcgagtaacgaggcgaacatgctggataaaattgttattgccaaccgcggcgagattgcattgcgtattcttcgtgcctgtaaagaactgggcatcaagactgtcgctgtgcactccagcgcggatcgcgatctaaaacacgtattactggcagatgaaacggtctgtattggccctgctccgtcagtaaaaagttatctgaacatcccggcaatcatcagcgccgctgaaatcaccggcgcagtagcaatccatccgggttacggcttcctctccgagaacgccaactttgccgagcaggttgaacgctccggctttatcttcattggcccgaaagcagaaaccattcgcctgatgggcgacaaagtatccgcaatcgcggcgatgaaaaaagcgggcgtcccttgcgtaccgggttctgacggcccgctgggcgacgatatggataaaaaccgtgccattgctaaacgcattggttatccggtgattatcaaagcctccggcggcggcggcggtcgcggtatgcgcgtagtgcgcggcgacgctgaactggcacaatccatctccatgacccgtgcggaagcgaaagctgctttcagcaacgatatggtttacatggagaaatacctggaaaatcctcgccacgtcgagattcaggtactggctgacggtcagggcaacgctatctatctggcggaacgtgactgctccatgcaacgccgccaccagaaagtggtcgaagaagcgccagcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttacagaaatgatcaccggcgttgacctgatcaaagaacagctgcgtatcgctgccggtcaaccgctgtcgatcaagcaagaagaagttcacgttcgcggccatgcggtggaatgtcgtatcaacgccgaagatccgaacaccttcctgccaagtccgggcaaaatcacccgtttccacgcacctggcggttttggcgtacgttgggagtctcatatctacgcgggctacaccgtaccgccgtactatgactcaatgatcggtaagctgatttgctacggtgaaaaccgtgacgtggcgattgcccgcatgaagaatgcgctgcaggagctgatcatcgacggtatcaaaaccaacgttgatctgcagatccgcatcatgaatgacgagaacttccagcatggtggcactaacatccactatctggagaaaaaactcggtcttcaggaaaaataagactgctaaagcgtcaaaaggccggattttccggccttttttattactggggatcgacaacccccataaggtacaatccccgctttcttcacccatcagggacaaaaaatggacactcgttttgttcaggcccataaagaggcgcgctgggcgctggggctgacccttttgtatctggcagtttggttagtagccgcttacttatctggcgttgcccccggttttaccggctttccgcgctggtttgagatggcctgcatcctgacgccgctgctgtttattggactgtgctgggcgatggtgaaatttatctatcgcgatatcccactggaggatgacgatgcagcttgaagtaattctaccgctggtcgcctatctggtggtggtgttcggtatctcggtttatgcgatgcgtaaacggagcaccggcaccttccttaatgagtatttcctcggcagccgctctatgggcggtattgtgctggcgatgacgctcaccgcgacctatatcagtgccagttcgtttatcggcgggccaggagctgcttataaatacgggctgggctgggtattgctggcgatgattcagcttcctgcagtctggctttcactcggtattctcggcaagaagtttgcgattcttgcgcgccgctacaatgcagtgacgctgaacgatatgctgtttgcccgctaccagagtcgtcttctggtgtggctggcgagtttgagtttgctggttgcgttcgttggtgcgatgaccgtgcagtttatcggcggtgcgcgcctgctggaaaccgcggcgggtattccttatgaaaccgggctgctgatttttggtatcagcattgcgttatataccgcctttggtggctttcgcgccagcgtgctgaacgacaccatgcaagggcttgtgatgctgattggcaccgttgtgctgcttattggcgtagtacatgccgctggcggcttaagtaacgcagtacagaccttgcaaaccatcgatccgcaactggttacgccacaaggcgctgacgatattctgtcgcctgcctttatgacgtcgttctgggtactggtgtgttttggcgtgattggcctgccgcatactgcggtgcgctgtatctcttataaagacagcaaagccgtacatcgggggatcatcatcggtacgattgtggtcgcaattctgatgttcggtatgcacctggccggagcgttaggtcgggcggtgatccccgatctcaccgtaccggacctggtgatcccaacgttaatggtaaaagtgctgccaccgtttgctgccgggatcttcctggctgcaccgatggctgcgatcatgtcgacaattaacgcccaactgctgcaaagttccgctacgatcattaaagatctctatctgaatatccgtccggatcaaatgcaaaacgagacgcgtctgaagcggatgtcggcggtaattacgttagttctcggcgcgttgctgctgcttgccgcctggaagccgccagaaatgatcatctggctgaatttgttggccttcggtgggctggaagccgttttcctgtggccgctggtgctgggtctttactgggaacgcgccaacgccaaaggcgcgctaagtgcgatgatcgttggcggcgtgctgtatgccgtactcgcgacgctgaatattcagtacctgggcttccaccctatcgtgccctcgttactactaagtttgctggctttcctggtcggaaaccgtttcggtacatccgtcccgcaagctaccgttttgactactgataaataaagagttttgccatgccttggatccaactgaaactgaacaccaccggcgcgaacgcggaagatcttagcgatgcgctgatggaagcgggtgccgtttctatcacttttcaggatacccacgatacgccagtatttgaaccgctgccgggcgaaacgcgcctgtggggcgacaccgatgtgattggtctgttcgacgctgaaaccgatatgaacgacgtggtggcgattctggaaaaccatccgctgctcggcgcaggcttcgcgcataaaatcgaacaactagaagataaagactgggagcgcgaatggatggataatttccacccgatgcgctttggtgaacgactgtggatctgccctagctggcgtgatgtgccggacgaaaacgccgtcaacgtgatgttagatccagggctggcgtttggtacgggtacccatccaaccacctctctgtgcctgcaatggctcgacagcctcgatttaaccggtaaaacagtcatcgactttggctgtggttccggcattctggcgatcgcggcgctgaaactgggtgcagcaaaagccattggtattgatatcgatccgcaggcgattcaggccagccgcgataacgccgaacgtaatggcgtttctgaccgtctggaactctacttaccgaaagatcagccagaagaaatgaaagccgacgtggtggtcgctaacatccttgcaggcccattacgtgaactggcaccgttaatcagcgtcctgccggtttcaggcggtttgctgggcctttccggtattctggcaagccaggcagagagcgtttgtgaagcttatgccgatagcttcgcactggacccggtcgtggaaaaagaagagtggtgccgtattaccggtcgtaagaattaaccttcgcatcgccgtagggtgacgcggggcgaagtgcgagcaagctcacaaaaggcacgtaaatttgccgattatttacgcaaatttgcgtgccaaaattttcattcataaagaaaaattgagaacttactcaaatttctttgagtgtaaattttagtcactattttctaatatgatgatttttatgagtaattatcgcaccacgctcattttaaatgcaattctttgatccatctcagaggattggtcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattacagacagaccttttcggacgttgtgctacgagatgggagccggattgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaagattcgcaccggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggcgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggatgtgaatgacctctatgagctggtactggctgaagtagaacagcccctgttggacatggtgatgcaatacacccgtggtaaccagacccgtgctgcgctgatgatgggcatcaaccgtggtacgctgcgtaaaaaattgaaaaaatacggcatgaactaattcaggttagctaaatgcttgattaaaaaggcgctactcggcatggggaagcgccttttttataggtgtcacaaagggagtgaccatgagaacaggatgtgaaccgacccggtttggtaatgaagctaagaccattattcacggtgatgcgcttgccgaacttaaaaagatccccgccgaaagtgtcgatctgatctttgccgacccaccatataacatcggtaaaaattttgatggtctgatcgaagcctggaaagaagatctgtttatcgactggctgtttgaagtgattgcagagtgccaccgcgttctgaaaaagcagggcagcatgtacatcatgaacagtacggaaaacatgccctttatcgatctccagtgccgcaagctttttaccatcaaaagtcgcatcgtctggtcatatgacagttctggagtgcaggcgaaaaaacactacggctccatgtacgaacccatcctgatgatggtgaaagacgcaaagaactacacattcaacggtgatgctattctggtagaagccaaaaccggatcgcagcgcgcgttgatcgattatcgcaaaaatcctccacagccttacaatcatcaaaaagtaccgggtaacgtttgggattttccgcgcgtgcgttatttgatggatgaatatgaaaaccacccgacgcaaaaaccggaagccttactgaaacgcattattctcgcctcttccaacccaggcgatatcgttctcgacccgtttgctggtagctttactaccggtgccgtagccatcgccagcggacgaaaattcattggtattgagatcaacagcgagtacatcaaaatggggcttcgacggctggatgtcgcgtcgcattactctgcggaagaactggcgaaagtgaaaaaaagaaagaccggcaacctgtcaaaacgaagccggttaagcgaagttgaccccgatctcattacaaagtaaaggatgtgtaagcctggttttcagattattcatttcgtgtatatttcctgccagacttggttaaacatgcacaggctcaggtaatgattcgcaagtattggtggctcgtcgttttcgctgtcttcgtttttctgtttgatactttactgatgcagtggattgaactgctggcaacagaaacagacaaatgccgcaatatgaactcagttaatccactaaaactggttaactgtgacgaactgaattttcaggacagaatgtgaatttacatgacacttaattcattcgtttgatgaattaatttcgttatgttttcatctggcatgaacattcttaatacgttatcgaccagagcgggggcttgtttataaagatcataacccgccatattcattaaccagttttgaacaattccgctgaaggcaccatcaataataatcatcacaacatctaaatcgaggttatttgctacacaaccttgttgctgacacgcctgcaatacttcgcggagagtctgcggattaaagcccatcttttcgcgtatcactccctcggccagcatctcatcattaaattcacatttgtgatataagattttcagcaacgcctgctggcggggaattttggcaatatattgcaagccgacaatcaatttttcacgcaattgttgaaacgggtcatgctctaatccagccgtcaagtgttcctggattaactcccgcaatgaaggctgttgcaaccacatctcattaaacagttgagtcttgttttcgaagtgccagtagatagcgccacgcgtaacgttagcggcgtcggcaatgtcgttgagcgtcgtcttgcttacgccatgctgcgcaaactgggcgatggcagtttcaatcagttcttgccgggtcttcagagcttcggctttggttctttttgccatgattaattattcaggaaataaatatattcgacacagagtgagaaaatagcgaaggttaatctatcacctaatgtgtatttatacgagaggctaatattgagttgctataaatcgttaaataaataatatatattatttacctaagatacattcactacatcaatatatatttcaatttacgaggttttaattctgcctctttcaacccgcgtcaaaataaaacagtagaatattaatctttttttgtgtttatgtgccttgagatgcctgtattcataactattccttacatcgacgaatgataatttgtaggatagcgaactgtatttttctttctgcgagttaacgcgttgcctttttgggtaaataacgcgcttttggttttttgaggaatagtaatgacgaaacatgccaggtttttcctcctgccctcctttattctgatctccgcggctttaatcgccggttgtaacgataagggagaagagaaagctcacgtcggtgaaccgcaggttaccgttcatattgtaaaaacggccccgttagaagttaagactgaattaccaggccgcaccaatgcttatcgtatagccgaagttcgcccacaggttagcgggatcgtactgaatcgcaatttcactgaaggcagcgatgtgcaagcaggccagtccctgtaccagatcgatcccgcgacctatcaggcaaattatgacagcgcgaaaggcgaactggcgaaaagtgaagccgccgccgccatcgcgcatttgacggtaaaacgttacgttccgctcgtgggtacgaaatacatcagccagcaggagtacgaccaggccattgctgatgctcgtcaggccgatgccgccgtgattgccgcaaaagccacagtcgaaagcgctcgcatcaatcttgcttataccaaagtcactgcgccaattagcggacgtatcggcaaatcgactgtgaccgaaggcgctcttgtcactaatgggcaaacgactgaactggcgactgtccagcagctcgatcctatctacgttgatgtgacccaatccagcaacgattttatgaggctgaagcaatccgtagagcaaggaaatttgcataaggaaaacgccaccagcaacgtagagttggtcatggaaaacggtcaaacctatcccctgaaaggtacgctgcaattctccgatgtgaccgttgatgaaagcaccggctccataaccctacgtgctgtcttccctaacccgcaacatacgcttttgccgggtatgtttgtgcgtgcacggattgatgaaggcgtccaacctgacgccattcttatcccgcaacaaggcgttagccgcacaccgcgtggtgatgcaaccgtgctgattgttaacgataaaagtcaggttgaagcgcgccctgtcgttgccagtcaggcgattggcgataaatggttgattagtgaaggactgaaatctggcgatcaagtcattgtcagcggcctgcaaaaagcgcgtccgggagagcaggttaaagccactaccgatacccccgcagatactgcatcgaagtaaggtaatctgacatggcaaacttttttattcgacgaccgatatttgcatgggtgctggccattattctgatgatggcgggcgcactggcgatcctacaattgcccgtcgctcagtatccaacaattgcaccgcctgcggtttctgtttcagcaaactatccgggcgctgatgcgcagaccgtgcaggatacggtgacgcaggttatcgaacagaatatgaacggtatcgataacctgatgtatatgtcctccaccagcgattccgccggtagcgtgacaattacccttaccttccagtccgggaccgatcctgatatcgcgcaagtgcaggtgcagaacaaactccagctcgccacgccgttgctgccgcaggaggttcagcagcaggggatcagtgttgaaaagtccagtagcagctatttgatggtggcgggctttgtctctgataacccaggcaccacacaggacgatatctcggactatgtggcctctaacgttaaagatacgcttagccgtctgaatggcgtcggtgacgtacagcttttcggcgcacagtatgcgatgcgtatctggctggatgccgatctgctaaacaaatataaactgacaccggttgatgtgattaaccagttgaaggtacagaacgatcagatcgctgccggacagttgggcggaacgccagcgttaccagggcaacaattgaacgcctcgattattgctcagacgcggtttaaaaatccggaagaattcggcaaagtgaccctgcgcgtaaacagtgacggctcggtggtacgcctgaaagatgtcgcacgggttgaacttggcggtgaaaactataacgttatcgctcgtatcaacggaaaaccggcggcgggcctggggattaagctggcaaccggcgcgaatgctctcgataccgcgaaagccattaaggcaaaactggcggaattacagccattcttcccgcagggaatgaaggttctctacccttatgacaccacgccattcgtccagctttctattcacgaagtggtaaaaacgctgttcgaagccattatgctggtgttcctggtgatgtatctgttcttgcagaatatgcgagcaacgctgatccccaccattgcggtacccgtggtgttgttagggacgtttgccatcctcgccgcttttggttactccatcaacacactaacgatgttcgggatggtgcttgccatcgggctgctcgtcgatgatgcgatagtggtggtggagaacgtcgagcgcgtgatgatggaggataagctcccgccaaaagaagcgacggaaaaatcgatgtcgcaaattcagggcgcactggtgggtatcgcgatggtgctgtcagcggtatttattccgatggcattcttcggcggttctactggggcaatttatcgccagttctctatcaccatcgtttcggcaatggcgctttctgttctggtggcattgattcttacccctgcgttatgtgcaacgctgcttaaacccgtctctgctgagcatcacgaaaataagggcggtttcttcggttggtttaataccaccttcgatcatagcgttaaccactacaccaacagcgtcggcaaaatcctcggatccacaggacgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagttacggattactatctgaagaacgagaaagcgaacgttgaaagtgtctttacggttaacggctttagcttcagcggccaggcacaaaacgccggtatggccttcgtcagtctgaaaccgtgggaagagcgtaatggtgacgaaaacagtgcggaagcggtaatccatcgtgccaaaatggaattgggcaagatccgcgacggttttgtcattccattcaatatgccagccattgttgaactgggcacggcaacgggtttcgactttgagttaattgatcaggctgggctgggtcacgatgccctaacccaggcccgtaaccagttgcttggtatggcggcgcaacatcctgccagcttagtcagcgtgcgccctaatggcctggaagacaccgcgcagtttaaactggaagttgaccaggaaaaggcgcaggcattaggtgtttcactttctgacatcaatcagaccatttcaacggcgctgggtgggacttacgttaacgacttcatcgaccgtggccgcgtgaaaaagttgtatgttcaggcggatgccaaattccgtatgctgccagaagatgtcgataaactttatgtccgcagcgccaacggcgaaatggtgccattctcggcctttaccacttcacattgggtgtatggctctccgcgactggaacgctacaacggtctgccgtcaatggagattcagggggaagccgcgccaggaaccagttccggcgatgccatggcgttgatggaaaaccttgcgtcaaaattacctgcgggcattggttatgactggacgggtatgtcgtatcaggaacgcttatcgggaaaccaggctcccgctctggtagcaatttcctttgtggttgttttcctgtgccttgctgcactctatgaaagctggtcaattcctgtctcggttatgttggtagtgccgttagggattgtcggcgtgctgctggcggcgacactctttaatcaaaaaaatgacgtctactttatggtgggcttgctaacgacaattggcttgtcggccaaaaacgctattttgatcgttgagttcgctaaagatctcatggagaaagagggtaaaggtgttgttgaagcgacactgatggcagtacgtatgcgtctgcgtcctatcctgatgacctctctcgcctttattctcggcgtattaccgctagctatcagtaacggtgccggcagtggcgcgcagaacgctgtgggtatcggggtaatgggaggaatggtctctgcaacgttgctggcaatcttcttcgtaccggtgttctttgtggtgatccgccgttgctttaaaggataaatcagaaacataaaggcgctttcgggtgcctttattatttccagtgaaacccataaaaattaataagatattcttctgctcactctttaaaagctttctatagttcccgctcccttcactatttttacaattcacataatttgtcattattcattccgcaagatttataacctccggtgataaaatggcattcagctcgttaataagagagttaacttattaagcgttagcgtttattactgaggtaacaccatgaaaagattaattcctgtggcattgctcaccgcattgctggcgggctgtgctcacgattcgccctgcgttccggtttatgacgatcagggtcgtctggttcacaccaatacctgtatgaaaggcacgactcaggataactgggaaacggctggggctattgccggcggggcagctgctgttgctggcctgacgatggggatcatcgctctatcgaaataactgaacagggcgcggagttccgcgctctttttaacgatacagtatctctccataagataaaatattgctatattctgctgggtaattccctgctgatttagcatgttacatcgcgttatttcgctgctttcgaaataacgcatcaatttaattttcacacttcccaccagaaatatactcacgctaacaatcattattctgcttagtaaaacacgcgtaaatattttgcgccaaaatgtggcgcatgtttcattttcgcaccattgcggggcgctgtttttattatttcctgtctacactcagcttattgcgacgcgaaatcgtgcgcaaaagctggcactacttttgcttataagaggatggccacagacaggtaaaagacgtttcccaaacgtcctataacgataattttcgcctcacaggaagcattatgaaaaagatgatgatagccacactggctgccgccagcgtgctgcttgccgttgcaaatcaggcgctgctggcgcgacgcttgatgccgttcagaaaaaaggttttgtgcaatgcgggatcagtgatggattacctgggttctcttatgccgatgctgacggtaagttttcaggtattgatgttgatatttgtcgtggtgttgccgctgctgtatttggtgacgacacgaaagtgaaatataccccgctcactgcaaaagaacgcttcaccgctttacagtcaggggaggtggatttgctctcccgtaatacgacctggacttcatctcgcgatgccgggatgggaatggcatttaccggcgtcacttattacgacggcattggcttcctgacgcacgataaagcggggctaaaaagcgcgaaagaactggatggcgctaccgtctgtattcaggcgggtactgataccgaactcaacgtcgccgactacttcaaggcaaacaatatgaagtacacaccggtgactttcgatcgctctgacgaatcagcgaaggcactggaatctggtcgctgcgatacgctggcctcggatcaatcacaactgtatgccctgcgcatcaaattaagcaacccagctgaatggattgtcttaccggaagttatctcaaaagaaccgcttggtccggtagttcgtcgtggcgatgatgaatggttctcgattgtacgctggacgcttttcgccatgctgaatgctgaagagatgggcatcaattcccagaacgtcgatgaaaaagcggctaatccagcaacgcctgatatggcacatctgctgggtaaagaaggcgattacggcaaggatctgaagctggataataaatgggcctataacatcatcaaacaggtgggtaactactcggaaatttttgagcgtaacgtaggttcagaaagcccgctgaaaattaaacgtgggcaaaataatctctggaataacggcggtattcagtacgcaccgcccgtgcgttaagtcggtgtgaggtaacgagcgtcgctacggcggcgctctcttcagcgttatgctttccgaggtttctatgtctcatcgccgctcaaccgttaaaggctcactctcttttgccaaccctacggttcgcgcctggttattccagatccttgccgttgttgctgttgtcggcattgttggttggttatttcacaacactgtaacgaatctcaataatcgtggcattacttcaggttttgcctttctggatcgcggcgctggcttcggtattgtccagcatttgatcgattaccagcagggcgacacctacggacgcgtttttattgtcggcttactcaatacgctactggtttctgcattgtgtattgtgttcgcttctgttttgggcttctttatcggtctggcgagactttcggataactggctgctacgaaagctttccacaatttatattgagatcttccgtaatattcccccgctgctgcaaatcttcttctggtactttgccgtgttgcgcaatttgcccggaccacgccaggctgtgagcgcgtttgatctggcctttttgagcaatcgtgggctttatattccgtcaccgcagctgggagacggatttattgcgtttatcctggctgttgttatggctatagtcctttctgttgggctattccgctttaataaaacataccagataaagaccggacaactgcgccgcacctggccgatcgccgcagtgttgatcattggtttgcctttactggcgcaatggctttttggcgcagcactacactgggatgtcccagccctacgaggctttaacttccgcggcgggatggttttaattcctgaactggcagccttaacgctggcactttcggtttatacatctgcatttatcgccgagattatccgcgctgggatccaggcagtgccttatggtcaacatgaagcggctcggtcactgggattacccaacccggttacgctacgccaggtcattattccccaggcattgcgggtgattattccaccgttaaccagccagtatctcaacatcgtcaaaaactcctctcttgccgccgctattggctatcccgatatggtttcgctgtttgccggcaccgtgctgaatcagacggggcaagccatcgagacgatagccatgaccatgtcggtctatctgattatcagcctgactatctcgctgctgatgaatatctataaccgccgcatcgcgatcgttgaacgctaaggagtcatgatgacaaaagtattgctgtctcatcccccgcgcccggcgagccataactcaagccgcgcgatggtgtgggtgcgaaaaaatctgttctccagctggagcaatagcctgctgactattggctgcatatggttgatgtgggaactgatcccaccgttgctgaactgggcatttttgcaggctaactgggttggctcaacgcgtgccgactgcacaaaagccggtgcctgttgggtcttcatccacgaacgatttggtcagtttatgtatgggctttacccacacgaccaacgctggcgaattaacctcgcattactgattgggcttgtgtcgatcgcaccaatgttctggaaaatactcccgcatcgcggtcgctatattgcggcctgggcggtgatttacccactgattgtctggtggctgatgtatggcggtttttttgctcttgagcgggttgaaacccggcaatggggcgggctgacgctaactttaattattgcatcagttgggattgcgggggcgctaccgtgggggatcttactggcgttaggtcgccgctcccatatgccgattgtgcgtatcttatcggtcatttttatcgaattctggcgcggcgtgccgctgattaccgttctgtttatgtcttcggtcatgctgccgttgtttatggcagaaggcaccagtatcgacaaattgatccgcgcgctggttggcgtgatcctgtttcagtcagcatatgttgcggaagtcgtgcgaggtggattacaggcgctgcctaaagggcaatatgaagcggcagagtcgctggcgttgggttactggaaaactcaggggctggttattctgccacaggcgttgaagctggtaattcctgggctggtaaataccatcatcgcactcttcaaagataccagcctggtgatcattatcgggttgttcgatcttttcagtagcgttcagcaggcaaccgttgatcccgcctggttgggtatgtcgacggaagggtatgttttcgccgcgctgatctactggatcttctgtttcagcatgtcgcgctatagccagtatctggaaaaacgttttaacaccgggcgtacaccgcattgaggacactatgagccaaattttactgcaacctgctaacgcgatgattacgctggaaaacgtcaataaatggtatggacaattccatgttttgaaaaatataaatttaaccgtgcaaccgggagaacggatcgttctgtgtggcccttcaggttccggtaaatcgacaaccattcgttgtattaatcatctggaagaacatcaacagggacggatcgtggtagatggcatcgaacttaatgaagatatccgcaatattgagcgcgtcaggcaggaagtgggaatggtctttcagcatttcaatctcttccctcatctgaccgttttacagaactgtaccctggcaccgatttgggtacgcaagatgcctaagaaagaggctgaagatctggcggtgcattacctagagcgggtgagaattgccgaacatgcgcataagtttcccggacagatttcaggtggtcagcagcaacgcgttgccattgcgcgttcgctgtgtatgaagccgaaaattatgttgtttgatgagccaacgtcggcgctcgatcctgagatggtgaaagaggtgctggatacgatgattgggctggcgcagtcgggtatgacaatgttgtgtgtaacacatgagatggggtttgcacgaaccgtcgctgaccgggtaatttttatggatcgtggggaaatagtggagcaagctgcacctgatgaattttttgcgcatcctaaatcagagcgtacgagggcatttttatcgcaggtaatccattaattgaatgttagttcgaaaagcaaaaaggccatcctttcggatggcctttcgcttgatttgatgtctggcagtttatggcgggcgtcctgcccgccaccctccgggccgttgcttcgcaacgttcaaatccgctcccggcggatttgtcctactcgggagagtgttcaccgacaaacaacagataaaacaaaaggcccagtcttccgactgagccttttgttttatttgatgtctggcagttccctactctcgcatggggagaccccacactaccatcggcgctacggcgtttcacttctgagttcggcatggggtcaggtgggaccaccgcgctactgccgccagacaaattcttttctaatctgccgaactttaacctaaaaagtggtgctgatacccagagtcgaactggggacctcacccttaccaagggtgcgctctaccaactgagccatatcagcacgctaaatttgatgcctggcagttccctactctcgcatggggagaccccacactaccatcggcgctacggcgtttcacttctgagttcggcatggggtcaggtgggaccaccgcgctacggccgccaggcaaattctgttttatcagaccgcttctgcgttctgatttaatctgtatcaggctgaaaatcttctctcatccgccaaaacagcttcggcgttgtaaggttaagcctcacggttcattagtaccggttagctcaacgcatcgctgcgcttacacacccggcctatcaacgtcgtcgtcttcaacgttccttcaggacccttaaagggtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagcatcacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtcaacgttagaacatcaaacattaaagggtggtatttcaaggtcggctccatgcagactggcgtccacacttctaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtccactttcgtgtttgcacagtgctgtgtttttaataaacagttgcagccagctggtatcttcgactgatttcagctccacgagcaagtcgcttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcgcaggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcacacgcctaagcgtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatgtgcatttttgtgtacggggctgtcaccctgtatcgcgcgcctttccagacgcttccactaacacacacactgattcaggctctgggctgctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcaccttaccgacgcttatcgcagattagcacgtccttcatcgcctctgactgccagggcatccaccgtgtacgcttagtcgcttaacctcacaacccgaagatgtttcacttcagagttgcgaaaatttgagagactcacgaacaactttcgttgttcagtgtttcaattttcagcttgatccagatttttaaagagcaaaacttcgcagtgaacctttgcaggtacactctgaagtattttttatttaatcactacagagatggtggagctatgcgggatcgaaccgcagacctcctgcgtgcaaagcaggcgctctcccagctgagctatagccccataacatgtagttaaaacctcttcaaatttgccgtgcaaatttggtaggcctgagtggacttgaaccaccgacctcacccttatcaggggtgcgctctaaccacctgagctacaagcctgtagaggttttactgctcattttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcttgccagtatcagatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgggtaacgtcaatgagcaaaggtattaactttactcccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttaccccaccaacaagctaatcccatctgggcacatccgatggcaagaggcccgagggtccccctctttggtcttgcgacgttatgcggtattagctaccgtttccagtagttatccccctccatcaggcagtttcccagacattactcacccgtccgccactcgtcagcgaaacagcaagctgtttcctgttaccgttcgacttgcatgtgttaggcctgccgccagcgttcaatctgagccatgatcaaactcttcaatttaaaagtttgatgctcaaagaattaaacttcgtaatgaattacgtgttcactcttgagacttggtattcatttttcgtcttgcgacgttaagaatccgtatcttcgagtgcccacacagattgtctgataaattgttaaagagcagttgcgacgcggctttcagctcactgtcgcgaggtggcgtatattacgctttcctctttcagagtcaaccctgaatttcaggatttttttctcttcgttgttccgaccatcctgtgaagtgtttcacgttgtcgtctcaacggaggcgcattatagggatcccaattttttgcacaagtatttttttgatctttttttctgtttgttgttttttcaccctttttgctgcaatcgcacacaaaacggtgcttttttgcatactaaaagacttgcacaaggccaataatgcccccaaagtcattagtaaatcatttattgctgaggtaagtatgtctgatgttttacgcccataccgcgatctttttccacaaatcggtcagcgcgtaatgatcgacgatagcagtgtcgtgattggtgacgttcgtctggctgatgatgtggggatctggccgctcgttgtgattcgtggagatgtacattatgtacagatcggagcacgcaccaatatccaggatggcagtatgttgcatgtcactcataaatcctcgtacaacccagatggcaacccattaaccattggcgaagatgtcactgttggtcacaaggtgatgctccacggctgcaccattggcaatcgagttttggttgggatgggctcaattttacttgatggcgcaatagtagaagatgatgtgatgattggtgcgggtagtctggtcccacaaaataaacggctggagagcggatatctgtatctcggtagccccgtcaaacagatccgcccgttaagtgatgaagagaaggctgggttacgctattccgcgaataattacgtgaaatggaaggacgaatatctggatcagggtaaccagacccagccttgatcatcttcactttgttcctgaattaagttttccgcttcttcttccaggtcccagcgatgctgacgaaaactcgctaaccactgttctggcgtatctccagtaaagcgatacgccagactctcgccagagatcgcgcatgtcagttgcataccattcacgagagcgggaaaacatacacattttttattctcgtcccactcttccctgtccggaaactggatggcctgattcacgcggacaattcctcctgcaattgctttataactggttctacgtcaggcagaacaccgtgccagagaagaaaggcatgagccgcctgtgccaccagcattcctaaaccatcagcattacgctttgagcctcgctgctcacaccatgccagaaaaggagtttttcctttctgatagaacatgtcatagcaataaatgcctggatgaatgagcgatgacgggatcgccggaatatcaccactgatgccactggatgttgcattaataatgagatcaaactcatgaccttccagttcgtccatactcaacgcctgaatactgccagtgtgcgcaaacaatttagccaactcttccgcgcgggataccgtccgattagttattgtcaccgcacagtccagggaaaggagtggcagtagtacgccgcgagatgctccaccagcgccgataagcagaatacgtaaaccagggcggataaaagacagacgttccagatcgcttaacaagcctacaccatcggtattgtcacccagcaggcgtccatcttctaaccgcatgagggtattaacagcaccagccaacgctgcccgttcagtaagctcatccgctctggcaaaagcctcttctttaaaaggcaccgtcacattcgcacctttaccaccagcactaaagaaagcgttcagtgtgttgatgaaatcattgatgggtgccaacacgcgcccatagggatgttcaatattcagttgctgagcaaattgctgatgaatgaatggcgatttgctgtgggctatcggattaccaaaaacagcataggtttccattatgttacccctgtcgaaacagttcacccgtcagggcatcgcggatttctgaaggatttaaacgcccccccgtttcaccaggcacaaccgggaacgccgcgccaaattgtgcgcgaacttcgtctactgttcgacaaggtggcaatccactcaagttggcactggtagaaaccagcggtttaccataagcctggcacaaagcaaccaccaacggatggtcggtgactcgtacagcaagcgaatcaaagcggcccgtcaaccagcgcggtgttgtcgcaggcgcgggaaagacaaaggtgacaggacctggccagcgggaaaaaatggtttcacgctgcacgtcagtcaacatggtgtcatcaatatagggtttaagctgctcgtaatttgctgcgattaaaatcagccccttatcaaccggacgctgttttaactccaacagtcgcatcactgctgtttcgctatcaggatcgcacccaacaccgaaaacggcttccgttggataggcgatgacacgttcttcattgagaacatctatcgcagctgcgatagcgtctctttgcaggttattattcacgttattattccgccgaaaccggctttccacattgtttactggcacaaaagtgttttacaccctgcgcggttttcttttcgatgagtagcggataatgacactcagggcattctccagctatgggtttgaagttaatggcaaattgacactccgggtagcgatcacaagagtgaaatgttttgccataacgggagcggcgctggaccagatggcccgtccgacattgggggcatgtaattgctgtttcgtccggtttatcgataagttcggtatgttcgcattcagggtagttaatgcaaccaataaacataccaaagcgtccctggcgtaataccagatttgcgccacatgcagggcaaacctgcccctccagaactttgacgatatgtccatccgctgaagatttcagaggacggacgtagtcacacgccggatactgtgagcatccaagaaacggaccgtgtttcccggatcgaataaccagttcagccccgcactttgggcaggactcattattacgcaccgtgaacagtgctgatttcgccataacaacttatgctgaattaaagaaatgattaatgcagcataccttcattcacttcaaagagtaattcttccatttgctggtacgcattttcgcagcccggaatattgaacaacaccatcaggatcacccatttcagatcatccagttcgaactctgcgttatccagcgcgagcactcgctctatcaccatttcacgagtttcaaggttgagcacctgaatctgctcaaggaaaagcagaaacccacggcagctggcatccagtcgttcacactcttccggtgtataaatacgcatggagagaggatccgaggccagttgcatcggttctgccaacccttcctgataatcagcaagtttttccagccatagcagggcattgtagatatcttctcgctcaaaacctgcgtcggtaagatcctgttcaagtttgtcttgatccacacgcaactcagcttctgtgtgaatataggtttcaaacaaatacattagtacgtcgaacatggcatgccctcctcaatcggacatagccgccgggtacagctgcgatccatcctgctaactccagttcgagtagttgagtaactacctctggcacaggttggccggcacgttcagcgacgacgtcaacaggtgttacctcatctcctacgttagccaggagctcaggaaatggcaatgccacgtcttgctgatctggtgaataaaatgaattttcaggggcgtctggcaaccagtgcaatccaaattgcaagttttccagaatttcttccggttccgtcacaagaatcgcaccttgttttattaaccagtgaggcccttcgcttcccggattccctattggacctggcaaggcaaaaacttctcgcccctgctcaagcgcacaacgtgctgtcaccagcgaaccactacgcaaagccgcttccaccaccagtacacctttacttagaccactgataatgcgatttcttcgtgggaaattgtaagcaaggggtggaacatcgaggggaaattccgagacgagagcgcccccctgttcaagcagactggcagccagtcgggcatgacggcggggatgaatggtattaagtccattccccaatacagcaatgctgacgccatttacctgtaaggctgctttatgcgctacaccatcgattccacgcgccagtccactcgtaattgtcactccacgcgtcgccagagtttcgcaaaataatcgtccccatcgctcgccataccatgaatgcgcccgactccccactacggcaagctgaaatgaatgcagcgcgtgcagttctccttcaacaaacagtgcgccggggtaatctgtcgtcgccagaagttgaggaggataaaattcgctgtccgcaggaattaaatgatggttgggttgctccaaccaacaaagtgagctttcgatactctttcgtggaaatgaaagaaagcgttgtgcctgccgcaatgtaagccctgtttgctgcaatacaaccgcatcaatatgcgactgttttgccacccagtgagcgatacggaccatatcatcgccgtacaagctgctgatactcattaaacgcagccaaatttctgtatcgaccatccttatctccctgccataagcagccttagcaatctttgcgattggtcagtgatgctgtcaatcagagggggatttgtctagaatagaagaaataatctttctaactcctgaacacatctctggagatttatgtcagttttgcaagtgttacatattccggacgagcggcttcgcaaagttgctaaaccggtagaagaagtgaatgcagaaattcagcgtatcgtcgatgatatgttcgagacgatgtacgcagaagaaggtattggcctggcggcaacccaggttgatatccatcaacgtatcattgttattgatgtttcggaaaaccgtgacgaacggctagtgttaatcaatccagagcttttagaaaaaagcggcgaaacaggcattgaagaaggttgcctgtcgatccctgaacaacgtgctttagtgccgcgcgcagagaaagttaaaattcgcgcccttgaccgcgacggtaaaccatttgaactggaagcagacggtctgttagccatctgtattcagcatgagatggatcacctggtcggcaaactgtttatggattatctgtcaccgctgaaacaacaacgtattcgtcagaaagttgaaaaactggatcgtctgaaagcccgggcttaaggataagaactaacgtgtcagaatcactacgtattatttttgcgggtacacctgactttgcagcgcgtcatctcgacgcgctgttgtcttctggtcataacgtcgttggcgtgttcacccagccagaccgaccggcaggacgcggtaaaaaactgatgcccagcccggttaaagttctggctgaggaaaaaggtctgcccgtttttcaacctgtttccctgcgtccacaagaaaaccagcaactggtcgccgaactgcaggctgatgttatggtcgtcgtcgcctatggtttaattctgccgaaagcagtgctggagatgccgcgtcttggctgtatcaacgttcatggttcactgctgccacgctggcgcggtgctgcaccaatccaacgctcactatgggcgggtgatgcagaaactggtgtgaccattatgcaaatggatgtcggtttagacaccggtgatatgctctataagctctcctgcccgattactgcagaagataccagtggtacgctgtacgacaagctggcagagcttggcccacaagggcttatcaccacgttgaaacaactggcagacggcacggcgaaaccagaagttcaggacgaaactcttgtcacttacgccgagaagttgagtaaagaagaagcgcgtattgactggtcactttcggcagcacagcttgaacgctgcattcgcgctttcaatccatggccaatgagctggctggaaattgaaggacagccggttaaagtctggaaagcatcggtcattgatacggcaaccaacgctgcaccaggaacgatccttgaagccaacaaacaaggcattcaggttgcgactggtgatggcatcctgaacctgctctcgttacaacctgcgggtaagaaagcgatgagcgcgcaagacctcctgaactctcgtcgggaatggtttgttccgggcaaccgtctggtctgatagtccactcttctaagcccggtcttgccgggcgtttttatacttatgaaaaaacaacgtaatttacgtagcatggcggcccaggccgttgaacaagtcgtcgagcaagggcaatcattaagcaacattctgccaccgctccagcaaaaagtttccgataaagacaaagcacttcttcaagagttgtgctttggcgtactgcgtacgctttcgcagttagactggctgattaataagttaatggcccgtccgatgaccggcaaacagcggaccgtgcattacctgattatggttggtttgtatcaactgctttatacccgcattccacctcatgctgcgctggctgaaacggttgaaggcgctatcgcaattaagcgtccgcaacttaaagggttgataaacggtgtattacgccagttccagcgtcagcaagaagagttattagccgagtttaatgccagtgatgcacgttatctgcatccttcctggttgctgaagcgtctgcaaaaagcgtatccagagcagtggcaatccatcgtcgaagccaataaccagcgtccgccaatgtggctgcgtattaatcgtacgcatcattcccgcgacagctggcttgcattgctggatgaagcaggaatgaaaggtttcccgcatgcggattaccctgatgctgtacgtctggaaacacctgcacctgttcatgcgctacctggttttgaagacggatgggttaccgttcaggatgcatcagcacaaggttgcatgacctggcttgcgccacaaaacggtgaacacattttggatctttgtgccgcccccggcggtaaaacaacgcatatccttgaggtggcaccagaagcgcaggttgttgcggttgatatcgacgaacagcgcctctctcgggtttacgacaatttaaaacgccttggtatgaaggcgaccgtgaaacaaggtgatggccgttacccttctcaatggtgtggcgagcaacagtttgatcgcattttattagatgcgccttgttcagcaaccggtgtgattcgtcgccatccagatattaaatggttacgtcgcgatcgcgatatcccggaactcgcgcaattgcagtctgaaattctcgacgccatttggccgcatttaaaaaccggtggaactctggtctatgccacctgttcggtgttaccggaagagaatagcctgcagattaaagcctttttgcaacgtaccgctgatgccgaactttgcgaaacaggaacaccagagcaaccgggtaaacaaaatctacctggtgccgaagagggcgacggcttcttttacgctaagctaatcaaaaagtgatgagataacgggtcgcgactgatgaaaattatcattctgggtgccggccaggttggcggcacactggcggaaaacctggttggcgagaacaacgatattactgttgtcgataccaacggtgagcgtctgcggaccttacaggataaatttgacctgcgggtcgtgcaggggcatggctctcatccacgcgtattgcgggaggcaggtgccgacgacgccgatatgctggttgctgtaaccagttcagatgaaaccaatatggttgcctgccaggtagcctactcacttttcaacacccctaatcgcatcgctcgtatccgctcaccagactacgtgcgcgatgccgataagctatttcattcagatgctgtgccgattgatcatctgatcgcaccagagcagttggttatcgataatatttaccgactgattgagtatcccggcgcattgcaggtggtgaacttcgctgagggtaaagtcagcctggctgtggttaaagcctattatggcggcccgctgattggtaatgcactttcgaccatgcgcgaacatatgccacatatcgatactcgtgtggcagcaattttccgccacgatcgccccattcgtccgcaaggttcgaccattgttgaagctggtgatgaagtgttctttattgccgcttcacagcatatccgcgcggtgatgagtgaattacagcgactggaaaaaccgtataagcggatcatgctggttggtggcggtaatatcggtgcagggctggcgcgtcgtctggaaaaagattacagcgttaaactcatcgaacgtaatcagcagcgcgctgccgaactggcggaaaagttacagaatacgatcgtcttttttggtgatgcgtcggatcaagaactactggccgaagaacatatcgatcaagttgatctgtttattgccgtcaccaacgatgacgaggccaatatcatgtccgccatgcttgccaaacgtatgggtgcgaaaaaggtgatggtattgatccagcgtcgcgcttatgtggatctggttcaggggagcgttatcgatattgcgatttcaccacaacaagcaactatttctgcgttgcttagccatgtgcgaaaagcagatattgttggtgtttcctcattgcgccgcggcgtagcagaagctattgaagccgttgctcacggtgatgaaagcacctcacgcgttgtcggcagagtcattgacgaaatcaagctaccgccaggaacgattattggagcggtggtacgtggaaacgacgtgatgattgccaatgacaatctgcgcattgagcaaggcgatcacgtaattatgttcctcacagataaaaagtttattaccgacgtcgaaagactcttccagccaagccctttcttcttgtaattaataaggcgtctaatgacgccttattatttccctttgattatcaaggattaattaaattcattcctggcaggaaaatggcttaacatttgttagacttatggttgtcggcttcatagggagaataacatgagcattattaaagaatttcgcgaatttgcgatgcgcgggaacgtggtggatttggcggtgggtgtcattatcggtgcggcattcgggaagattgtctcttcactggttgccgatatcatcatgcctcctctgggcttattaattggcgggatcgattttaaacagtttgctgtcacgctacgcgatgcgcagggggatatccctgctgttgtgatgcattacggtgtcttcattcaaaacgtctttgattttctgattgtggcctttgccatctttatggcgattaagctaatcaacaaactgaatcggaaaaaagaagaaccagcagccgcacctgcaccaactaaagaagaagtattactgacagaaattcgtgatttgctgaaagagcagaataaccgctcttaacaagcgcctgaaagcagaagaccagtggtaaaaaagtgatttactttcttgccactggcctcccagttcccccgattgccatgttttccttttcgcatgtaactgcctttccccttcttatttttctctacgcgctgtcggaataagggatcatgtagtaatgcttctatcgcattatcctttatctgccctttagtatgctgatatcgactcataaaaactccagttggttatttaacggcgcgagtgtaatcctgccagtgcaaaaaatcaacaaccactcttaacgccactcgccccttgttcaagagcttcaagaatcgaacaataaacactgctatgagcagtcccacaacaggcatcgttaaggcgttgcaaggaacgctgcatactctgcaactcggctatccgtgcttcgacttcctgcaatctttcctgcacaatgccttttgactcctgacaggtatggtgttcaggatcgatgcggatcgacagcaactcgcggatcgactccagactgaaacctagttgtctggcatggcggataaatttcaatcgctggagatcgctttcggtatataggcgaaacccaccttcagtacgcacttcatgctccatcatctgctgtttttcgtaataacgaatcgtgtcgggtgttacttccgccatttttgccagctcaccaatgcgatacatacatactccactagttatcgttgattttgtccaacaacttgtcagcataatcgccgcgtaaaaaatcggtactcaatccagcttgtcgcagcttcaattccagtaatgacaatcgacggctaacctcttgatattgcggatcatcgtgacggatacctttgagaatatccagaagctgaattgcttctctccgttgctcaagttctggcggtaagcaaccggcattcttcagcaagcgataccccgcacgtaattccggtggcacgtgagaatcatcatccagtatcaatggttcgccgctacctgccaggttatcaaactcacctttcgcttgcgcttctgctatatggcgctctgcccactggtcaagtaaccacataaatactccaggggatgaacaaaaagagtacagctattgtagataagtggggatactacgggtataaaaaaacccgccggggcgggtttttttacgttgcttcagattactctgcagcagcttctgctttctctgaacgatcaaccagctcgatgtaagccatcggcgcgttgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacagtccacgggaagccagcacgtctttaatctcagtaagagattttttaccaaggttaggcgttttaaggagctcaacctcggtacgctgtaccagatcaccgatatagtggatagcttctgctttaaggcagttagcagagcggacagtcaattccagatcgtcaacagggcgcagcaggatcggatcgaactctggtttctcttctttcacttcaggctgacgtacatcacgtaagtcaacgaaagcttccagttgttcagccagaatggttgccgcacgacgaatcgcctcttcaggatcgattgtgccgttggtttccatttcgatgaccagcttgtccaggtcggtacgctgttctacacgcgctgcttcaacattgtaggcaatacgctccacagggctgtagcatgcgtcgaccagcagacggccgattgggcgctcatcttcttccgaatgaattcgggtagaagccggcacataaccacgaccgcgctgaactttgatacgcatgctaatagacgcgttctcatcggtcaggtggcagatcacgtgctgcggcttgacgatttcgacatcaccgtcgtgggtgatatcggctgcagtcacagggccaatgccagatttattcaaggtaagaataacttcatctttgccctgaactctcaccgccagccctttcaggttgagcaggatttccaggatatcttcctgaacgccttctttggtgctgtactcatgtagtacaccatcaatctcaacctcggtcaccgcgcaacccggcatcgatgagagcagaatacggcgcagtgcgttacccagagtatggccaaagccacgctctaaaggctcaagggtcaccttggcgtgcgtcgaactcacttgctcgatatcaaccaggcgcggttttagaaactctgtcacagaaccctgcattgtgtcctctctttggtactaagctttacttggagtaaagctcgacgatcaggtgttcgttaatgtccgcagacagatcagaacgctccggcttacgcttaaacgtaccttccatcttgccagcatcaacttccagccaggttggcttttcacgctgctcagccagctccagagcggctttcacgcgagactgcttcttcgctttctcacgaatgcttacaacgtcattcggactaacctgataagaagcgatgttaacaacacgaccgtttaccataattgctttatggctaaccagctgacgtgcttctgcacgagtggcaccgaagcccatacggtatacaacgttgtccagacgaccttccagcagagccaacaggttttcaccggtgttgcctttcagacgtgctgcttctttgtagtagttacggaactgacgctccagcacaccatagatacggcgaactttttgcttttcacgcaactgcacaccatagtcagacagacgcggtttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaacaaacctggaaaacgaggcgttatacgcgacgttttttcggcggacgacaaccgttatgagggatcggagtcacatcagtaatgttagtgatgcggaaacctgcggcgttcagagcacgaatagtagattcgcggcctggacccggacctttaaccataacttccagattcttgatgccgtattctttcacggcgtcagcgcaacgctctgctgcaacctgagctgcaaacggagtggatttgcgagaaccacggaaaccggaaccaccggctgttgcccaacccaacgcgttaccctgacgatcagtgatagtcacgatggtgttgttgaaagaagcatggatatgagccacgccgtcagagacttgttttcttacacgtttacgtgcacgaattggtgcctttgccattattcaatcaccccgattatttcttgatcggtttgcgcggacccttacgggtacgtgcgttggtcttggtacgctgaccgcgaaccgggagaccacgacgatgacgcaaaccgcgatagcaaccaagatccatcaggcgcttgatgctcatgctgatttcacggcgcagatcaccttcaacgacaaatttggcaacttcgtcacgcagcgtgtcgatttgtccttcagacagctcactgatcttaacatcttcagcgatacccgctgcagccaggatggctttagaacgggtcttgccgacgccataaatcgaagttaatgcgattacggcatgcttatgatcaggaatgttaatgcctgctatacgggccactatgcactcctactatttaatatgtacgttccatgctgaaaagcccgttttcaggatactcaaatggaaacgcacagacatacaaaagattggctggctaatctagccagctcaacccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcgggcgaccaattatcggccgtagcctttcaggttcgccttcttcaatgcagactcatactgactggacatcatcagagtttgcacttgagccataaagtccataatcacgacaacaacgataagcagtgaggtcccaccgaagtagaacggtactttcattgcatcacgcatgaactccgggatcaggcagataaaggtaatatacagcgcaccaaccagggtcaggcgggtcattactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccgcccccgaaccatgacgcgatggtcgccgggaacagaataatactggaagcgaagattgccgggattacccccgccatattcactttcagcggtaaatgtgtgctctgtgcagcatagacacgacgaccttgctgacgtttcgcgtagtttaccacaatgcggcgttgaccacgctcaacaaatacaacaaagaacgtcactgcaaatactaatactgcaaccaacagcaacacgaggaagtgcaggtcgccttgacgcgcttgctcgatagtatgggcaatggctggcgggagtcccgcgacaataccggcgaagataatgattgaaataccgttgccgatacctcgttcagtaatctgttcgcccaaccacatcaggaacatggttcctgtgaccagacttacaacagcggtgaagtagaatgcaaagcccgggttaatcaccaggccttgcataccaggcatattcggcagaccggtagcaataccgatcgactggaatattgccagcaccagagtaccgtagcgggtgtactggctgatcttacgacgaccagactccccttctttcttaatttctgccaacgttgggtgaaccaccgtcagcagctggataatgatcgacgccgaaatatacggcatgatccccagagcaaagatagaagcacggctgagagcaccaccagagaacatgttaaacatctcaatgatggtgcctcgctgttgctcaagcagtttggcaagtacagcggcatcaataccagggatcggaataaaagagccaatacggaacacaatcagcgcaccgataacaaacagcagtctgcgtttcagctcgcctaagccacctttggcactttgaaaatctaatcccggttgtttagccatctgctacttattcctcgattttaccgccagcagcttcgatagcagcacgagcgcctttagtaacacgcaggccacgaacagttaccggagtcgttacttcgccagccaggatcactttcgcgaactcgatctggataccgataatgttagccgctttcagcgtgttcaggtctactacaccgccttctactttagccaggtcagacagacgaatttcggctgtaatcgctgctttacgagaagtgaagccgaatttcggcagacgacggtacagaggcatctgaccaccctcgaaaccgcgacgtacgccaccgccagaacgagacttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgatcataccgcgaatagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatttctggagaattcatattttccaggccatcaatagttgcacgaaccacgttgatcgggttggtggaaccataggctttagccagaacgttatgaaccccagcgacttccagaacggcgcgcattgcaccaccggcgatgataccggtaccttcggaagccggctgcatgaatacgcgagaacccgtgtgaacacctttaacagggtgttgcagagtgccgttattcagcgcgacgttaatcatattgcgacgggctttttccatcgctttctggatcgctgctggaacttcacgcgctttaccgtaaccaaaaccaacgcgaccgttaccatcgccaactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggatacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagggtattatctgcatgtttaacttcaacagcatcgttgagagtacgagtcagctcgccgtttttacctttgatcgtaataacctgaccgttgatttttacgtcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagacccgccataactttcggcagctcatctttacgtttatagatgcgcagacctgggcggctgacacgctgaatgctttctacaacagctttgccctggaaatacttcagagtaagttccagttcaggcttggtgtcgccttcaactttaaaatcttcaataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccgggatttcaccgcgcatagcggcttcacggaccttaatacggctcaacccgaacttccgcaggaaaccatgcggacgacctgtttgacggcagcggttacgctgacgagacgggctggaatcacgcggcagagtctgcagcttgagaacagcgttccaacgatcttcgtcggaagcgttcacatcagagatgatcgctttcagttcagcgcgtttcgcgaagtatttatcagctaaagctacgcgttttacttcgcgtgctttcattgattgcttagccatttagtaaccctaccttacttgcggaacgggaagtcaaaggcagccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccaaattacttgatagtttcgctgttagacttgaagaaacggacttttttaccgtcttcgaatctaaagcctacacggtcagccttgccggttgccgcattgaagattgctacgttggaaacctgaatagcggcttctttttcaacgatgccacccggttggttcagggccggaaccggcttctgatgtttcttaaccaggttgataccttcaacaatgaccttgccggaagacaggacattcttaactttaccgcgtttacctttatctttaccggttaacacgataacttcgtcatcacgacggattttcgctgccatgattcgctccttagagtacttctggtgccagagagataattttcatgaacttctcactacgaagctcacgagttaccggcccaaaaatacgcgtaccgataggctgctcgctgttgttgttcagaagaacacaagcattaccatcgaagcgaatgacagaaccgtccgggcgacgaacacccttcttggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaatcaggtcgttaaaaatccccatatcgagggcgcggcattataacaccgcttcaaggatatgggtagaaaaaataaacggctcatttctgagccgtttattcgtattgagagagtgtactgtattacagaaccgctttctctacaacgcgaaccagcgtccaggatttagtcttggacagcggacggcattcgcggatttcaaccacgtcaccgataccgcattcgttgttctcgtcatgtacgtgcagtttggtcgtacgcttgatgaatttaccgtagatcgggtgtttcacaaaacgttcgatagcaacaacaatggatttctccattttgtcgctaacaacgcgaccttgcagagtacggattttatcggtcattacgcacccgccttctcgttcagtaaagtcttaacgcgtgcgacatcgcgacgcacttgcttcaacaggtgagactgttgcagctggccacttgcagcctgcatacgcaggttgaactgctcacgcagcaggttcagcagctcggtgttcagctcttcaacgctcttctcacgcagctcttttgctttcattacatcaccgtcttagttacaaaggtggttttaatcggcagtttcgctgctgccagcttgaatgcttcacgggccagctcttccggaacaccgtccatttcatacaggactttacccggctgaatcaaggcaacccaatactccacgttacctttacctttacccatacgcactgccagcggcttttcagtgatcggtttgtccgggaacacacggatccagatcttaccttgacgcttaactgcacgggtcatagcacgacgtgctgcttcgatctgacgggcagtcagacgaccacggccaacagctttcagaccgaagctgccgaagctaacatccgtaccctgcgccagaccgcggttacggcctttgtgcattttacggaattttgtacgctttggttgtaacatcagcgacgctccttatttacggcctttacgctgctgctttttaggctgagcagccggtttttccggttgttcaacagcagccataccacccaggatctcgcctttgaagatccacactttaacgccgattacaccgtaagtggtgtgcgcttcagaggtgttgtagtcgatgtcagcacgcagagtgtgcagcggtacgcgaccttcgcggtaccattcggtacgtgcgatttccgcgccgcccagacggccgctaacttcaactttaatacctttagcgcccagacgcattgcgttctgtacagcacgcttcatagcacgacggaacataacgcgacgttccagctgagaagtgatgctgtcagcaaccagttttgcgtccagttcaggcttacgaacttcggcgatgttgatctgtgcaggaacgccagcgatgtccgctacgaccttacgcagtttttctacgtcttcaccttttttaccgataacgatacccgggcgagcagtgtgaatggttacacggatgctcttagccggacgctcgataacgatacgagatacggacgctttagccagttccttagtcaggtactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccaaccatttcgtcggttacaaataccggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgaacgccccacggagttaccgggtgcttaccaaagttacgaccttcaccaccaccatgtgggtggtctaccgggttcatcgcggtaccgcgaacggtcggacgaacaccacgccagcgtgcagcacctgctttacccagaacgcgcagcatatgctcagcattgccaacttcgcccagagttgcacggcagtctgcttctactttacgcatttcaccagaacgcagacgcagggtgacataagcaccatcacgagcaacgatctgaacgtaagtaccagcggaacgtgccagctgaccgcctttacctggtttcatttctacgttatgaacagtagaaccaaccgggatgttgcgcatcggcagggtgttacctggtttgattgcagcatcaacgccagactgaatctggtcgccagctttcaggcctttaggggccaggatgtaacggcgttcaccgtctttgtacagaaccagcgcgatgttcgcggaacggttcggatcgtactcaagacgttcaacaactgccgggataccgtctttgttgcgtttgaagtcaacaatacggtaagcctgcttgtggccaccaccgatatgacgagtggtgatacggccattgttgttacgaccaccggatttgctgtttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttagcaactttgagtacgatggtgttggatttttccatcgcagtagacgctttttcagaaacgtgcggtgcacgcagcaccttcagcagacgttcttcacgaatcatgccagcatctcctcaacttgcttaacagcatcagcagtcattacgactttgtcgaaggcgatcaggctaaccgggtcgataccagttgcatcgcgtacgtcaaccttgtgcaggttgcgcgcagccaggaacaggttttcgtccagctcaccggtgatgatcagcacatcttccagagccatgtctttcagtttctgtgccagcagcttagttttcggcgcttctacagagaacttctcgacaacgatcagacgatcctgacgtaccagttcggacaggatgcttttcagcgcgccgcggtacatcttcttgttaactttttgactgtggtcctgcggacgagcagcaaaggtcacgccaccagaacgccagatcgggctcttgatagaaccagaacgcgcacggccggtgcctttctggcgccacggttttttaccggaaccagttacttcagcacgagtcttctgagcacgagtaccctgacgagcaccagctgcataagcaacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcacctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgccagctttagcgaagtggccagcttcaggcttggtcacacggttagcttttttagcaccggtggtcacctgaatagcacggtagccatcgttagccaggtctttaacctgagtaacgcggtttgcttcaacttcgattacggttactgggatagaaacgccgtcttctgtgaagatacgggtcatacccacttttttaccgactaaaccaatcattgtttcaacctctcaatcgctcaatgacctgattaacccaggctgatctgcacgtctacaccggcagccagatccagacgcatcagagcatcaacggttttctcggttggctcaacgatgtcaaccagacgcaagtgagtacggatttcgtactgatcgcgcgcgtctttgttgacgtgcggggagatcagaacagtgaagcgctctttgcgtgtcggcagcgggatcggaccacggacctgcgcaccagtgcgcttggcagtctcgacgatttccgcggttgcttgatcgatcagacgatgatcaaacgctttcaggcggatacggattctttggttctgcatgagaccagagctccaattattttataaacgaaaatgattactcctcagacccattacgattgatgggagagtgtaaccgttcttacgtagctccccgattgggagcattgttaggtagccaaattcggctaactgaggttcagattgaacctgctgtcaactacgacaagcccgcgcattatacatacttaaccaccgaacgcaagcgtattgctagtaaagtaaacagccttcgggttatctctcaagttcgttcagtgcatttttgacacgctctcttaaaccggctttctcttcgctttcttccacagtattttcttcgtcttcagaagaagagggggcattctcaaccgcgacgcctgggtcatcttcctcctcgacggattcgacgacggggagtggctgttttttgaagaaatagtgttgtgttgattgtttaaaagcgggcgtttcagcctctacagtgacttcggcttttactatccaaagcacccatagctgcctggcatacccaccaaccagcaccattcctgcaaaccacaggcaaatcagtaataaacaaattacatatattatggtgctgtgtttttgtcgggagaagataccagggtgacctgtttctttctgctcacgcgcggcgatatagaattcaaacatgtcatttccccttcactgttgtttccggggaaatatttgcttcatcccgatataagtaggcactctcccctgccacctgccagagatgtactaacgttgaaaagccaacaacaccgtcagttttcaagtggtggcttttttgaaattgctttattttttctaccaacaagggacgccactccgccgaaggttctgtcgaaatatgcaatgcgcggtttaacatcgtttccagccagagaatctcttcctcgctgctatcacgcgtaatggtactctccccttccggcgacattttccacaacagaagataatcacccgtccataccgactcaaaccatttatgtgtcagcgtccacgtttgctgacctacgaggacatcaacgctagcctcaccgacgcgaacgaccacaacaggcaattttttgtccccgactttaagcgatgcgatccagggcaaattctgatctaccaatgtttgtaaagaagcattcccacttttacatgccagccccgctcttactgcctgatcgcaccaggccgaatcagctgggacctcgtacccccatacgccgtataacacgcttagcgcctcactatcgcgcatcaccacatgagcaatatccttagtcatatcttgtttaactactggcgttacgggtatcagccacgcaggaacgggtaacgtagctgtaaaagaggacagcagtagccaaccacaggtaagagcgataatggttccactcatcaccacggcaagctgcattttccgggggcggttatcacccaatatgcggtaaatcattcgccattgttttgctgtgaaaacgctggtctgctcggcttgctgtaataagcgaattgtttcgccggcaagcgccagctttctgcgatcgccccgacataataaagctatccgtttcagaactctggcggttaaaaggagatcgggttggtcaatattctgaccttcaaggatgcttgccttaagttcgtgctccgtcagacgtcctatcgagacaagttcaatgccctgttttttaaaatcacgttcgacttttcgatcgggtctgccgatcagcaaaaattgaccgtcaggaataagagatattgcgcgttggagatcatcaagtatgcggcggtgattcaggtgagcattttcaataataataagagggcagcgactatcagttcgatgaagcgcatgcagtaattgccccgccatctcatctcgcgtccaggcgctgtcacggcagccctgttcagccgcgttatcgtcggtaacgatccatgcggccttaccttgccaggaaacaacgaggcttaaagtaatcacacggcgatgtttatctttttgcagttgctgcgccagccaggtttttccacttccagcctcacccaacaaatagcatagacgccaggtttgacgtttctcacacaaccaggaaagaataacttctcttctcgtagacatagaacttcctgttttaattattgattatccttaatcataaaaataatgtatgtatttattaattaaatacatattactaatataaataaattttgcttgattcatgcaagcggcattaatactatttatactaacgtcaatatacaacccacccaatctattttattagaacatacatcgtgcccacactacgtttccccttccatctggcgaatcataataaagatgctgccatcaatatattgattatatttataagcatagggtcgattatttttaatgtgaattatttccatacaactatagttaaaaatggacagatcattaatcaaccaacaaacgcatttcagtctgatttcagccttgccgctttatggcgtaacgaaaatcatgctggggtaaaagatgcaaatcccgtggcagttaatcaggaaacacctaagctctctatagcgcttaatggcattgtactcacatcgaatgatgagacttcttttgtcttaattaatgaggggagcgaacaaaagcgatactccctcaacgaagcccttgagtcagcgccgggaacgtttattagaaaaataaataaaaccagcgttgtgtttgaaactcacgggcattacgaaaaagtaactctccatccagggctacctgacatcatcaagcagcctgattcagaaagtcaaaatgtactcgctgattatattatcgccacgcctatacgtgatggagaacagatatacgggcttcgattgaaccctcgtaagggcctcaatgcatttaccaccagcttgctacaaccaggggatatcgccctcaggatcaataatctttcgctgacccaccctgatgaggtttcacaggcattaagtttactgctaactcaacaaagtgctcagtttacaattcgtcgcaacggcgtaccccgcttgataaatgtttccgtcggggaacttacaggaatgaatggactgcgtcatgaaaggactcaataaaatcacctgctgcttgctggcagcactactcatgccttgtgcaggacacgctgagaacgaacaatacggcgcgaacttcaataacgccgatatccgccagttcgtggaaatagtgggtcagcatcttggcaaaacgatcctgatcgacccttcggtacagggaaccatttccgtacgcagtaatgatacgtttagccaacaggagtactaccagttctttttaagtattcttgatctttacggttattccgtgatcacgctggacaatggttttctgaaagtggttcgctcagctaatgtaaaaacatcgccagggatgattgctgacagttctcgtccaggcgtaggtgatgagttggtcacccgaattgtaccgcttgagaacgttcctgctcgtgacctggcccccctgctccgccagatgatggatgcgggtagcgtcggtaatgttgtgcattatgaaccctccaacgttcttattctgaccggtcgtgcctccaccattaataaactgattgaagtcataaagcgcgttgatgtcatcggcacagagaagcagcaaattattcatctggaatatgcgtcagcggaagatctcgccgagattcttaatcaattaatcagcgaaagccacggtaaaagccagatgccagccctcctctccgcgaagattgtggcggataagcgaaccaactctcttatcatcagtggaccggaaaaagcacgccagcgcatcacttcattactgaaaagccttgatgtcgaagagagcgaggaaggaaatacccgggtttattacctgaaatatgctaaagccacgaatctggtggaagtgctaaccggtgtttccgaaaagctgaaagatgaaaaagggaatgcgcgtaagccctcctcttctggcgcgatggataacgtcgccattaccgccgatgaacagactaactctctggtcattaccgctgaccagtccgtccaggaaaaactcgccacggtaattgcgcgtctggacattcgccgtgcacaggtgctggttgaggcaatcatcgttgaagttcaggatggaaatggactaaacctcggcgtgcaatgggcgaataaaaacgttggcgcacagcaatttaccaataccggattaccgatttttaacgctgcgcaaggtgtggctgattataaaaagaatggtgggatcaccagcgcgaatcctgcctgggatatgtttagcgcctacaatggcatggccgcaggcttcttcaatggcgactggggagtactgcttaccgcgctggccagtaacaataaaaatgacatcctcgccaccccaagcatcgtaacgctggataataaactcgcgtccttcaacgtggggcaggatgtgccggtgctatccgggtcacagaccacttcaggggataacgtctttaataccgtcgaacgcaaaacggtggggacaaaactcaaagttactccgcaggtcaatgaaggcgacgcggtgttgctcgaaatagagcaggaagtctccagcgttgactcttcctctaactcgacgctcggcccgacgtttaatacccgtactattcaaaacgccgtgctggtcaaaaccggtgaaacggtggtcctgggcggattgctggatgatttttctaaagagcaagtgtcaaaggttcctctgcttggcgatattcctttagtggggcaactcttccgctatacctccaccgagcgcgctaaacgcaacctgatggtatttatccgtccgacgattatccgtgacgatgatgtttatcgctcactgtcaaaagagaaatacacccgttaccgtcaggagcaacaacagcggatcgacgggaaatcaaaagcgctggttggctcggaagatttgccggtgctggatgaaaacacgttcaacagtcacgcccctgcgccatcgtcacggtgaggcattcatatgagaattcactcaccgtaccccgccagttgggcgctggcacaacgaattggttatctctattcagagggcgagattatttatctcgccgatacgccattcgagcggttactcgatattcaacgtcaggttggccagtgccagaccatgaccagcttgtcacaggctgattttgaagctcggctggaagcggtattccatcagaataccggtgagtcgcaacagattgcgcaggatatcgatcaatccgtcgatcttctctcgctttcggaagagatgcccgcaaatgaagatctcctgaatgaagattcagcggcaccggttatccgcttgatcaatgcgattttgagtgaggccatcaaagaaaccgcctctgatatccacattgaaacctatgaaaaaacaatgtcgatccgttttcgcatcgacggcgttttgcggacaattttacagccaaacaaaaaactggcggcactgcttatctcccgaattaaggtcatggctcgtcttgatatcgccgaaaaacgtattccacaggatggaagaattagtttgcgtatcgggcgacgtaacatagatgtccgcgtatccacactgccgtccatctatggtgaacgcgccgtactccgcctgctggataaaaacagcctccagctttcattgaacaacctggggatgacggcagcggataagcaggatttagaaaatctcattcagcttccgcacggtattatcctggtgacagggccgacaggctccggtaaaagcaccacgctctacgccatcctttcggcgctgaatactcccggccgcaatattctgacggtagaagatcccgtggaatatgagctggaaggcattgggcaaacgcaggtgaatacccgtgtggatatgtctttcgctcgcggcctgcgcgccatacttcgccaggacccggatgtcgtcatggtgggggaaattcgtgatacagaaaccgcgcagattgcggttcaggcctcgctcaccggccatctggtactctcaacactccacactaacagtgcatcaggcgcagtgacccggctccgcgacatgggcgtcgaatcattcctgctttcgtcttccctggcagggattatcgcgcaacgtctggttcgtcgcctgtgtccgcaatgccgacaattcacgcccgtatcaccccaacaagcgcagatgtttaaatatcatcagctcgcggtgacaacaattggcactcccgtaggctgccctcattgccatcaatccggctatcaggggcgcatggcgatccacgaaatgatggtggtgacgccggaattacgggccgctattcatgaaaatgtggatgaacaagcactggagcgactagtccggcaacaacacaaggccttaatcaaaaatggcctgcaaaaagtgataagcggtgacacctcctgggatgaggttatgcgcgtcgccagtgccacgctggagagcgaagcatgaattatcgctatcgcgccatgacccaggatggtcaaaaattgcaagggatcattgatgctaacgatgaacgtcaggcacgactgcggctgcgtgaagaagggcttttcctgctggatattcgcccccaaaaaagttcgggagtaaaaacacgtcgcccgaggatcagccatagtgaactgacgcttttcacccggcagttggcaaccttaagcgcagcggcattacccctggaagagagccttgccgtaatcggtcaacaaagcagtaataaacgactgggtgacgtgttaaatcaggtacgcagcgccatccttgaagggcatcccctttccgatgcattacagcattttcccacgcttttcgattcgctctatcgtaccctggtaaaagcgggcgaaaagagcgggctgctggccccggtgttggaaaagctggctgattacaatgaaaaccggcagaaaatccgcagcaagctcattcagtcactgatctacccctgtatgctcactacggtggcgattggggtcgtgattattctcctcactgctgtcgtgcccaaaattaccgaacagttcgtgcatatgaagcagcaactgccgctgagtacacgcattcttttaggtctgagcgacacgttgcaacgtaccggcccgacattattagcgacagtgtttattgtcgctgtaggtttctggctctggttaaaacgcggcaataaccgccaccgttttcatgccatgttgctgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgtctggcaaatgcggcagagaacgttcgccagggtaacagcattcatctttcgctggaacaaaccgcaattttcccgccgatgatgctctacatggtggcctctggcgaaaaaagcgggcagctcggcacattaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaaggaaagcatatgcgcgcaacggataagcaacgcggttttacattactggaaattatggtggtgatcgtcattatcggcgtacttgccagcctggtggttcctaacctaatgggcaataaagaaaaggcggataagcaaaaagccgtcagcgatattgtggcgctggaaaacgcccttgatatgtacaaactcgacaatcatcactatccaaccacaaatcaggggcttgaatccttagtagaagcgccgacactgccaccgctggccgcaaactataacaaggaaggttatatcaagcgtctgcctgccgatccctggggcaatgattatgtcctcgttaatcctggtgaacatggtgcatacgatctgctttcagcagggcccgatggtgaaatgggaaccgaggacgacatcaccaactggggtttgagcaagaagaaaaagtaagtcagcgatgaatcagcaacgcgggtttaccctgctggagatgatgctggtgctggcgctggtcgctatcacggcaagcgtggtgctcttcacatatggccgggaggatgtcgccagcactcgtgcgcgcgaaacagcggcgcggtttaccgctgcacttgaattagccatcgaccgcgccacgctcagtggtcagcctgtcggtatccatttctctgattcagcatggcgcattatggtaccgggcaaaacaccatcagcctggcgctgggttccattacaagaagatgccgcagacgagagccaaaatgactgggatgaagaactctcaattcatcttcagccatttaaacctgatgacagcaaccagccacaggttgtgattctggccgacggacaaatcacgcccttctctttgttgatggctaacgccgggaccggtgagccgctcctgacgttagtctgttcaggctcatggcccctggatcaaacgctcgccagagatacccgcccatgaacaaacaatcagggatgacactgcttgaagtcttactggcgatgagtattttcaccgctgttgctctgactttaatgagcagtatgcaagggcaacgaaatgccatcgagcgaatgcgtaacgagacgctggcattgtggatagcggataaccagcttcagtcacaagattcattcggcgaggaaaacacgtccagttctggcaaagagttaataaatggcgaagagtggaactggcgcagcgatatccactcaagcaaagacggcacgcttctggaacgcaccataacggtgacattacccagcggtcagacaacctcgcttacgcgttatcaaagcatcgataataaatccgggcaggcacaagatgattaatcgccagcagggtttcacattgctggaggtcatggcggcgctggcgattttctcaatgcttagcgtgctggcgtttatgattttttcgcaagcttccgagttgcatcaacgctcacagaaagaaatccagcagttcaatcagctacagcgcaccatcaccattcttgataacgatctcctgcaactggtcgcccggaggaatcggagtacggacaaaatcatggtgttgggtgaagaagctatttttaccacgcaaagtcgcgatccgctggctcctctcagtgaagcacaaaccttactcactgttcactggtatctgcgaaatcatacgctctaccgtgctgttcgtacttctgtggatggcaggaaggatcaacccgcccaggcgatgctggaacatgtcgagagctttcttctggaaagtaacagcggggaaagccaggaacttcctctctcagtcacgttacatctgcagactcagcaatatggggggttacagcgccgttttgcattacctgagcagttagcgagagaagagtcgccagctcagacgcaggccgggaataataaccatgaataatgaacaacgcggcgtcgcgctgctcattgtactcatgttactggcgctcatggctgctctggcagcagacatgacgctcagttttcacagccagcttcagcgaacccgccaggtaaaccatcatctgcaacggcaatatgatattgaactggcggagaaacttgcgcttgccagcctcacccaggacgttaaagataacgacagacagaccacgttgcagcagtactgggcacagccacaacagttgcagctggaagatggcaatacagtgaagtggcagttacgcgatgcccagcactgttttaatctcaatgcgttagcaaaaatctctgacgacccgctggcttcccctgatttccccgcccaggtattcagtgcgctgctgattaacgccggtatcgatcgcggaaacaccgatgagatcgtgcaatcaatcgctgactatattgatgtcgatgactcaccacgctttcacggcgcagaagatagcttttaccaaagccagacgccgccccggcatagtgccaatcagatgctttttctgactggcgaattacgtcagataaaaggcataaccgaaaacatctatcagcggcttatcccgtatgtctgcgttctcccgaccacggaacttagcatcaatcttaatatgctaacggagaacgatattccgctcttcagagcgttattcctcaataacatcacggatgctgacgctcgggtcttattgcaaaaaaggccgagggaaggctggctaaccacggatgcatttctttactgggcgcagcaggatttctccggtgtgaagccactggttgctcaggtgaaaaggcatctctttccctatagccgctattttacgctgagtacggaaagtatcagcgacgaacaatcccagggatggcaaagccatatttttttcaaccgtaaacagcagagcgcccaaatctatcggcgtacgctgcaactctactaatcataaggatcgtgatgcctgaatcgttgatggtcatacgttcttcctcgacgctgcgtaagcattgggaatggatgacgttctccgcagatagcgtatcttcggtacatacgctcacggacgatcttccgctggagtcgctggccgatcagcccggtgccggaaatgttcatcttttgatcccaccagagggccttttatatcgttccctcacgctgcccaacgccaaatacaaactcaccgcacaaacattacaatggctggcagaggagacgttacccgacaacacccaggactggcactggacggttgtcgataaacaaaacgaaagtgtcgaggtgataggcattcagtcggagaaactcagtcgctatcttgagcgtttacatactgccggactcaacgtgacgcgggttttgccagatggctgctatcttccctgggaagtagatagctggactctggttaaccagcaaacaagctggctcattcgcagtgccgcacatgccttcaacgaactggatgaacactggttacagcatcttgctgcccagtttccgcctgagaatatgctttgttatggtgtagtacctcacggcgttgcagcggccaatccacttatccagcatcctgaaataccatcactgagtttgtattctgccgatattgcattccagcgctatgacatgctgcatggtatttttcgtaaacagaaaactgtaagcaaatcgggaaaatggctcgcccgcctggcagtaagctgtctcgttctcgccattctttcttttgttggcagccggagcatcgcgctctggcatacgcttaagattgaagatcaacttcagcaacaacagcaagaaacctggcaacgttatttcccgcagatcaaacgcacccacaattttcgtttttactttaagcagcaactcgctcagcaatatcctgaagctgtgccgttgctctatcatttacaaacacttctgctggaacaccctgaactgcagttaatggaggcgaactatagccagaagcaaaagtcgctgaccttaaaaatgagtgctaagagtgaagctaatatcgatcgtttctgtgagttaacacagtcctggcttccgatggaaaaaacagaaaaagatccggtcagtggtgtatggacagtaaggaactcagggaaatgattaaatcatggtgggcagaaaaatccacatcggaaaaacagatcgttgcggcactggcggttctctcgctcggcgttttttgttggcttggggtgataaaaccgatagatacctacattgcagagcatcagtcccacgcgcaaaaaattaagaaggacatcaaatggatgcaggatcaagcgagcacccatggtttactcggtcatcctgcgcttacgcagcccatcaaaaatatccttctcgaggaagcaaaacgtgagaatttggctatcacgctggaaaacggcccggacaatactctgacaattcatcctgtcacagctcccctcgaaaacgtctcccgctggctcactacggcacaggtaacatacggtattgttattgaagaccttcagtttactcttgccggaaacgaagagatcaccctcaggcatttgtccttcagggagcaacaataatgacaatgctactgccgctcttcattctggttggttttattgcagattattttgttaatgccatcgcctatcacctctcgccgttggaggataaaacggcgttaacgtttcgccaggtattggttcatttcaggcaaaaaaaatatgcctggcatgatacagtgcccctgatactttgtgttgctgctgctatcgcctgcgccctggcacctttcacgcccatcgtgactggcgcactctttctctatttctgtttcgtactcacgctcagtgttattgattttcgcactcagctcctgcccgacaaactcaccttaccgctgctctggcttggcttggtatttaatgcgcagtatggattaattgatttacatgatgcggtttacggcgcggtagcgggctatggggtgctgtggtgtgtttactggggcgtctggttagtttgtcacaaagagggattgggctacggtgatttcaagctactggccgctgcaggcgcatggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctggggtatctggcctggatctcttattaaccgggagggttctccctcccgacacggctcaaccttcttcgcggatctgtgcttgcagataattttgcaggcccatcttctgaatcagatcaagttccgtttccagccagtcgatatggccttcttcatcacgcaaaatttctatcatcatatcgcggctgacgtaatcatgaacgctatcggcataaccaattgcctcacgcaaattcttcgcgccatccagctcaagtgccagatcagaacgcagcatttcctcaacatcttcaccaatgttcagtttgcccaggtcctgtaagtttggaagaccttccagaaaaagaatgcgctcaatataacgatcggcgtgtttcatctcatcaatggattcatgatactccacatcattgagacgtttgagaccccagtttttaaacattcgggcatggagaaagtactgattgattgcgacaagctcatttcccaacagtttgttgagataatttataactttagtatcacctttcattttttgactccttcgcttccactctttgaagagtagaacggcttacgagtaagtcaaaaaacacactccgtttatgcggactccttaaactccggcagctgcattaattcatcctccatcacttcacgcgcggcccggacacatttaccgcactgattgccgaccggaataaatttttttaattgctggaacgagtgaggggaaaactggcgcacagcctgacgaatttttttatcgctgataccattacaaagacaaacgtacatagagactcccgtatactttcttcaaaaataaatgaaaatagttcttatttcaattacggaaagactcttttttaagcaaagaatagaaatatgaataaaaataatgggctaccaaaagtagcccattgacaaaaaatgcggcgatactggaaggtatcgccaacacatttattgcttagtaaacggcgcgaagatttcgctaaatgcgtacttcggtgcctgttctttagtcaggccgtggaattccggagacaggttagtgccgcccggcaggtcgcgcgcgattgaccagataccaaccataccgagattacgcttctgcgcatcctgcatgaccagacgagcatcagagagatagaacacctcgccctgaacgtcgttcacgccaaccatcggcgtggtacccatcatagcgtcaatttctgcatcgctcttattgggatggaggcctttcaattgtgaatgcaggttggcaatcgcagacgttgcacacttaccgtgaatgttctggccttcggtatttgcagactgacaaatcgcgttaccgtagtccattgtcatcacgttcacacccgccagctcaacacctttcgctttggcatcgctcaggacattcatcccttccggcgtcaggccagtcggcagaattggcaaggtgtaccagatagcaatatctttgccttctgacttccatttatcctgcactttcttcacagcaaggttacgacgttcaatagatgcctgatccgcaacccaggtgccttcgatatcgaagtccaggactttgaggttcaggttatcaacgatgtcataataatgctgcatcagatcgtctacgttcttacaggaagcagccagcggagcgttgttagcaccaccgatagacagcatcacatcgccgccagcctcacgcagagctttgattttgctgtactgagcgtaattctgcataccgtaagcggtaccccatgtcggcagacaggtgttcgcatctttactcaccacaaacgccagcgtgaagtggttgacgttatgattcttagccagcgcagccagatccgggatcgtattcagcgtaaagtcgacatacggtgcataaacgtgtttcggccacgctttcttcggcgtacctacgcgctctttggttccggtccagtcaacaaaaacacgccacgggttgctgtcagaaggagaaactttctgcactttactctgagaaatgtagttcacaccgttaaagcgaatcagcgtatcgctggcataaagcgtttctggattaaactgcggcgcattattcagctcttcgttgctatagctctgagccttacctaacggcttccacgggcggctattgctaccggtggcgttttggttcgccaccagagcagggttgtcactttgcgtccagaacagcgcttcataagcctgcccatcaacaacaacgcgatcacctttcacgtacacagtggatgcggaccatgctttcgccggttcgtatttcttccacgggttatcgccgcccgggacaaagccccatgcgtcttgatcgacagaagttttataatgtgcatcgttataatctacgatgctgtccgcgctgtacgctttgctggcctggaaaccatccgcaacaatgacgccgccgttatcaatttcacaggtagtcgggttaccgtactgactcaattccgcagcggtagctgtacgctcgagacgccatgggttattggagttttcagcgctggtaccccgtgggcaatctttagacccaacccaccaggcgttcttgtaaacattaccattgaaaataacatggtaaatttcgctaccttcctggccgctccacgcttgcaatgagtaatcgttaacgctatccgctggtgttgatggctcgctgttatccggagttggggtcaccggtgtttccggagttggatcaaccggagtcacagcaccgccattattatccggcttaacggaacaggagccagggttaccatactggctgatttctgttgccgttgccgcgcgaacataacgccatgggttactggcatcgttttctttcgcatcgcctgggcaatttgccgcgcctacccaccaggcgttcttataaatgccgccgttatagataacgtaccatgtagaagaaccttcctgacctttccaggctactacagcatagttgtcgtttgacttatcagctggggctggctgaacatcaggagccggtttaacgtccggtgccggtttcacatccggtgaaggctgtggtgctgaagtacaggactgtggattactggtttctgagatttccgttgccgtagcggcacgaacataacgccatgggttgctggcatcattgcttttcgcatcacccggacagttagaagaggctacccaccaggcatttttatataccgcaccattaaagacgacataccaggtctgaccgccctgctgtttattccaggcaactacagaagaattagacggaacagtgccctgtgctggtgtagccgaaccgccattagccggcgtattggatgcaggcgtatttgaatttgaagaagatgagctgccgctcttttcgcaggaaagtgtattgccaaactgactaatttcagcagctgttgcggtacgctttaaacgccacgggttagttgcatcatttgctttcgcttttcccgggcaatttgtagaagaaacccaccaggcattttcataaattttgccatcgaaaataacctgatatttattaccaccttgttggttattccatgcttccattgccaatgctggcagagcggaacacaccagccccataccaatcatagatttagtaaatatatttaatttcattataatcccttgtgacgtaaaaactgcaaaacaaaagtcctacgcaggaattatttacgttttacgagaacccttcaatatgaattaaattacggcattaaaaataagaaaaaagcctgacaaatgaagcattttaaaaacagaaacattcatatttaaaatgttaaattgaattgatattttaaatatgaataatttattcgttctgacagtacgaataagatatgccgtcaacaaatgcaaaaagggcgccgaagcgcccttttcaattcaaaactaattaacgtgtaattagcccagaactttagcaacaacgcccgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtaccagtcacgtcagtagtacggaagtagaactgcggacggtagcctttgaagaacggagtatgacggccgccttcatctttggacagaatgtacacttcagattcgaacttggtgtgcggcttgatggtgcccggcttagccagtacctgaccacgttcgatttcttcacgtttgataccacgcagcagaacacctacgttctcaccagcacggccttcgtccagcagtttgcggaacatttcaacgccagtacaggtagacttctgagtctctttgataccaacgatttcaacttcttcaccaactttgatgataccgcgttctacacgaccggtaacaacggtaccacgaccggagatggagaatacgtcttcgatcggcagcaggaacggcttgtcaatcgcacgctctggttccggaatataagaatccaggaagccagccagttccaggattttcgcttcccactctgcgtcgccttccagcgctttcagagcagaaccacgaacgatcggagtgtcgtcgcccgggaagtcgtactgagacagaagttcacgaacttccatttcaaccagttccagcagctcttcgtcatcaaccatgtcgcatttgttcaggaacacgatgatgtacggaacgcctacctgacgacccagcaggatgtgctcacgagtctgcggcatcgggccgtcagtcgcagcaactaccaggatcgcgccgtccatctgagcagcaccggtgatcatgtttttaacatagtcggcgtgccccgggcagtctacgtgtgcgtagtgacgggtcggggtgtcgtattcaacgtgagaagtgttgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatagtgtatgatgcacgacctttggtcagagaacgcagctgagttgcgtatccgaacatttcagacagcggtacttcagcgtggatcttaacgccagtaacttcagattcctgacctttgagcataccacgacgacggctcaagtcaccgataacgtcaccggtgttctcttccggagtttctacttcaaccttcatgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgatagcagcagcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtaaacacggaagaaggtcaggttaccaacaaacgggtcggtagcgattttgaacgccagtgcagagaacggctcgtcatcacttgcgtgacgttcagccggagtgtctttaccgtcgtccaggataccgttgatcgcaggtacgtcaaccggggatggcaggtaatcaattaccgcatccagcatcgcctgaacacctttgttcttgaacgcagaaccacaggttaccaggatgatttcgttgttcagaacgcgctgacgcagagcacctttgatttctgcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatgcgcggaactttatatttgtttgcctgacgccatacggtttcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggataaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcagcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccgccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggggtgcttaaccgtaagtctgacgaaatcagtatagtcaatgagaatgatgtcgttcgaaatttgaccagtcaaaccgcgggcaataaggtcttcgttcagggcatagaccttaatgggggcattacgcagactttcaaggtagcggttaccgtcaactgcggcagttacgccatcttgcaataatagcagttcgtctccttcactgagcagacgcagcagcgcagcaaaatccgtcagccagggtgagcgatgtaatgtgtgcagcataaacgcctcaaaacctcaaaataacatcgtagttggcgagttcgcggcgtaaggcatctgcttcgagcggcgtggcttcgacaacaaagggtgtctgcggatctaacccgcgttcgcgcagtgaagccgcacaaacccagcactgttcaatgtcgtacagacccaacaatttaaaagtggcaatgtaatcacgcgccagcactgcatcgggcttttgtcctggcagcagctgaaaaacgccatcagctataaagaagacagccagatcgtcagttaatgcggaagttgccagtaaagcatctaaaccttcccggcctgcggctgtaccatgaggtgcagtagaaaaaacaaacgcaattcgtttcatcagaactgtaccaccctgtcacaggtcagcgaggcttccgccagcgccccaagtccgcttaaggtaaatccctgctgaaggtttgacgaagccagccccagtcttccggcctccgtttcatcaacaacgccacggcgtaatgctgccgctacgcagatattcagcgccacaccatgttgcgcattcagttgttgccaggcccgtacgaggtcaaattcgtcacttgccggagaggtcaattggttagcgttatagaccccttcccgatagaaaaagacgctgcttaactcatggccatctgctatcagcgcctgcgcaaactgaaaagcactactcgcctgttgcgtaccgtatgctggcccggtcaccacgatggcaaaacgcattacttatcttgcccctggaaatcaccgctcttgaactggcggatgtagagatagacagtgtgtttggagatgttcaggcggtcagcaacctggttgatcgcatctttaatatcgaagatccctttctcgtagagattcagcacgatctgacgatttttggcgttattagaaacattgcgatcggcattcacttcttcgatggtgaactccagcgtttgggtaaccagatcttcaacagaagaggcaaagttgacgcttgaaccgacatccggggtttctggcggcacaaaggtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcagtaattggcgaaccaatcttccggcctgtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcgaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcggttcttaatgcttattttttagcagaatctgcggctttcgcatcagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccgggataacaccgtccagacggaaagaaagcggttcaccacgggtgtaagagttgtcgaactctttaccgtcgatcagcgtacctttgtagttcactacaacagtatcgctgtctttcggtgcttcgcctttaccggcttctactacctgataaaccagaccagttgaagaggttttcacacctttctctttggcaaatttctcgcggtactctttaccttttgcttcgttatcagccgcgtctttttccatcttcgcctgagcagaagacttcacgcgagcttcgaatgcttgtagagtctgttcgatctcttggtcggagagtttgctcttatcagcaaatgcatcctgaacaccagcgatcagctgatctttatccagtttgatgcccagtttttcttgttcttttagagagttttccatgtaacgacccagcgaggcacccagtgcataagctgatttctgatcgtcatttttgaacgctgctttgctgtcagcagctgtagcaggttttgcagcttcagcagcaaaagtgattggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagttaaaagccagccagccgtcgaacatcgcgtcgcaggctgaagaaacgccaccgccacattattgaggcgtaaaaaaagcggggattccccgcttttttgtcactttttcggtattagtggcaaccgcaaccgccgttgcctttaccgccacagcagccttcgccaccgtgttcatgaccgtgatcgtggccatgaccgccgcagcaaccgtcgtggtcgtgatcgtggtggtgatcgtgcgcgccgtgaacgtgaccatgagccagttcttcttcagtcgcttcgcgaatcgccacaacttcaacgttgaatttcaggttctgaccggccagcatgtggttaccatcaaccacgacgtgatcgtcttcaaccgcagtgatttcaaccggtaccggaccctggtcggtttcagccaggaaacgcatacctacctgcagttcatcaacgcccataaatacgtctttaggaacacgttgcaccaggttttcgtcgtactgaccgtaagcgtcgttcgcgccaacagcgacatcaaatttgtcgccaacttcatgaccttccagcgccgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccgatcacttgctcatctttgcgaacgtgatcgcgggcttctttgtctgcttctcgcatctgatgtccgcacttaacacattcaacaatatcaatattattttcgcgccacatcgccattgaatcctgcgcctgacaggccgggcattttgcgcccgcaataaaacgttttcggattgccatctttaccctctactcaaattcatcccagccgtccagctggcgtcgttcttgttgcatttcacgctggaaaatctcttccagttcgcgtcgggcttccctggcgcgagaaatttgtacggtatcggcatgcattgggatgagctctcgcagcatccgcatatccaggcggcgaaaatgcagttgcgctcgctgtgcctgatgcggatgcatgccaagcgtgaccagcgtcttgcgccccagctctaacgcactggagaatgtttcacgggaaaactgcgtcacccctgcctgtaataactcatgcgcttccacacgtccgcgcgctcgcgcaagaatatgcaaatgcggaaagtgctgttggcatatttccaccagcttcatggtgtcttccggctcgttacaggtaatgacgatagactcagcggcctctgcacccgcagaacgtaaaagatcgacctgcgtggcgtcgccgtaataaactttgtagccgtatttacgcatcaggttaacggcgctgatatcccgctccagcacggtaatgcgcattttatttgccatcagcaaacgaccaatcacctgaccaaaacgcccgaagcccacgacaatgacctggggtttatcatcgttgacccacggtttttcgtcttcttcttccggtccgttaaactggcgggatagccatttatccaccagcttcatcagcaacggcgtggtcatcatggaaagcgtcaccgtcaccagcaacaacgccatctggtcgccctggaataagcgttgtgaagaagcggtagaaaagaggacaaaggcaaactcaccaccctgactcaacacgccagcaaactgcatccgctctgagctacgcacgccatacaatcgcgccagcagatacagcacgagaattttcaccgccaccagcacaaccacgcttatcactacccacaacagatgggtataaagcaccccgaggttgagtgacatgccgacagagataaagaacaaaccgagcagcaagcctttgaagggatcgatagccgtttccagttcatggcgatattcactttccgccagcagcacgcccgcaataaatgtaccgagcgccatcgacagccccagcgcatccataaacaatgcggaacccaacaccagcagcagcgtcgcggcggtgaacacttcccgcacgccagaagctgcaataaagcggaataccggacgcagtaaatagcgcccaccaatcagcatgccgacaaacgccagcaccttcatgccgaccttcatccagtcgaaatgttcgtctgccgaccccgccaacaacggcactaacgccagtgctgggattactgccagatcctgaaacagcagaaccgaaaacccgagctggccggattcgctgcgattcatccctttctcacgcatcaattgcaacgccattgcagttgaagacatcgcaaggccaatgccaccgaccaccgccgcctgccaggcgaaatccgtcagcatcaataatcccgccagcaacgccgcgcttaacagcacctgtgccgcgcctacgccaaaaatcgaacgccgcagttgccaaagtttggagggattcaactcaaggccgatgataaacatcaggaataccacgccgagttccgaaaagtggaggatctcatcgacgtcgctaataaaccccagcccccacgggccaattgcaatccctgccagcaaatatcccaacacagcgccaatacccagccgcgatgccagcggcaccgcagccaccgccgcgaagagaaacagcactcctgcgagtaaaaaatcggaaccttccatcagcggcctcctggagacagcggatttgccagccagtcaccgtaggctctggcgtggctcgccagctcctgtgcgctttgccgtctcgcccagtaaataatgatgggacttaaccaatgcatccggcacatgcccgccgccagttcaaaggggcgcagcacatcgctcatcgggtagcgattcagcgcgtcataacggtaagcactttccggctcgccggtggtaatcacgctacgccagtactttcccgccagttggtttcctcccggcccgctggcaaaaccacgacttaatacccggtccagccactctttcagtagcgccgggcagctataggtataaagaggatgctgaaagacaatcacctcgtgctcgcgcagtaatgcctgctcacgggggatatcaataaaaaaatcgggatagtgcgcgtaaaggtcgtgcacggtaacattgctgagctgcgtggccggtttaagcagtacccggtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcaccttatgattgttttctcctcgttacaaattcgtcgcggcgtgcgcgtcctgctggataatgccaccgccaccatcaaccctgggcagaaagtcggcctggtgggtaaaaacggctgtggtaaatctaccctgctggcattgctgaaaaatgaaatcagcgccgacggcggcagctacacctttccgggaagctggcaactggcgtgggtgaatcaggaaacgccggcgttaccgcaagcggcgctggaatatgtcattgacggcgaccgtgaatatcgtcaactagaagcgcagctacacgacgccaacgaacgtaacgacgggcacgccattgcgaccattcatggcaagctggatgctattgacgcatggagtattcgctcccgtgctgccagcctgctgcacggcctcggtttcagcaatgaacaactggagcgcccggtaagtgatttttccgggggctggcgtatgcgtcttaaccttgcccaggcgctgatttgccgttcagacttgctgctgctcgacgaaccgactaaccacctcgatctcgatgccgttatctggctggaaaaatggctgaagagctatcagggcacgctgatcctgatctctcacgaccgcgacttcctcgatccgatcgtcgataaaattattcatatcgaacaacaaagcatgttcgagtacaccggcaactacagttcgtttgaagtacagcgcgccacccgtctggcgcagcaacaagcgatgtacgaaagccagcaggaacgcgtagcgcatctgcaaagttatatcgaccgtttccgtgccaaagccaccaaagcgaagcaggcccagagccgcattaagatgctcgagcgtatggagctaattgcccccgcgcacgtcgacaacccgttccgctttagcttccgcgcgccggaaagcctgccaaatccgttactgaagatggaaaaagtcagcgcgggctatggcgatcgcattattctcgactcgattaaactgaacctggtgcccggctcgcgtattggtctgttaggccgcaatggcgcgggtaaatcgacattaatcaaactgttagccggtgaacttgcgccagtcagcggtgaaattggtctggcgaaagggatcaaactcggctacttcgcccagcatcaacttgaatacctgcgcgccgacgaatcacctattcaacatctggcacgtttagcgccgcaggagctggaacaaaaactgcgtgactacctcggcggctttggtttccagggcgataaagtaaccgaagaaacgcgccgcttctccggtggggaaaaagcccgcctggtgctggcattaattgtctggcagcggccgaatctgctgctgctcgacgaaccgactaaccaccttgacctcgacatgcgtcaggcactcaccgaagcattaatcgagtttgaaggcgcgctggttgtcgtttcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaatgcgaacagcgcccaggcacgtaaagatcagaagcgtcgggaagctgagctgcgtgcgcaaacccagccactgcgtaaagagattgcccgtctggaaaaagagatggagaagctgaacgcgcaactggcgcaggcggaagagaaactcggcgacagcgaactgtatgaccagagccgtaaagcggagttgaccgcctgcctgcaacagcaagccagcgccaaatccggcctggaagagtgcgaaatggcatggctggaagcccaggagcagcttgagcagatgctgctggaaggccaaagcaactgatggcgcagataacgacgaccgatgccaatgaattcagcagcagtgctgaattcatccccatgcgcggctttagcaattgtcatctgcaaaccatgctgccgcgtctgtttcgtcgtcaggtgaaattcaccccgtactggcagcggctggagttgcccgacggcgattttgtcgatcttgcgtggagtgaaaaccctgcacaggcgcaacataaacctcgtctggtggtgtttcacgggctggaaggcagtctcaacagcccttacgcccacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgaatttggtcatgcgccaacggctgccgtcggctattcgctcggcggtaatatgctggcctgtttgctggcaaaggaaggcaatgatctcccggttgatgcggcggtgattgtctctgcgccgtttatgctggaagcctgtagctatcatatggaaaagggcttttcccgcgtttatcagcgttacttgctgaacctgttaaaagccaatgccgcgcgcaagctggcagcctaccccggaacgctgccgattaatctcgcgcagttaaaatcggtacgtcgcatccgtgaatttgacgatctcatcaccgccagaattcacggctacgccgacgctatcgactattatcgtcagtgtagcgccatgccgatgctgaaccggatcgccaaaccgacgctgattattcacgccaaagacgatccgtttatggatcatcaggtgatcccgaaaccggaaagtctccccccgcaggtggagtatcaactgactgaacatggcggtcatgttggctttattggcggtacattacttcatccgcaaatgtggctggagtcacgcattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtcgccgacgtcaaacgccagctacagtgcggagaagcggtgctggtatggtcggagctgcacgaaacggtcaatattatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagctgaggtggaaggcgacagttttcaccgttacacccgcccggaaatggacatggcgatccgcaaagcgcgcgacgccgggcggcatatcagctacttcggccccgaggctaacgacttcggcctgctggaacaaaccttcattgaatacggtcagagcggcaaagggaaatctcgcaaatatctgcatacctacgacgaagccgtaccgtggaatcaggtaccggggacattcaccccctggcaacctttaccggaacccactgatgtactgttttatgaaggtttacacggcggcgtagtcacgccacagcataacgttgcgcagcatgtggacttactggtcggcgtggtgcctatcgttaaccttgagtggattcaaaaactgatccgcgacaccagcgagcgcgggcactcacgagaagcagtgatggactcagtagtgcgttcaatggaagactatatcaactacatcacaccgcagttttcccgcacccatcttaacttccagcgcgttcccaccgtcgacacttcaaacccgttcgcggcaaaaggtatcccgtcgctcgatgaaagctttgtggtgatccattttcgtaatctggaagggatcgatttcccctggctgctggcgatgttgcaaggctcattcatttcccacatcaatacgttagtggtaccgggcggcaaaatgggtctggcaatggaattaattatgctgccgctggtgcaacgattgatggaaggaaagaaaatcgagtaactctgctattacgccggataaaatactatccggcttcacaacgggatagttaagtcacgcggcaaccacttcatacgagtgagtaatattcaccgctttttccagcatcaacgccactgaacaatatttctcggcagagagatcaaccgcacgcgcaaccgctgcgtctttcaggtcgcgaccggtgacgataaaatgcagattaatgtgcgtaaacaggcgtggtgcctcttcgcggcgttcagaggtcaattttacttcacaatcgaccacatcctgacgccctttttgcaggatcgaaaccacatcgatggcactgcaaccacccgccgccatcaacaccatttccatcggacttggtgctttatcgcctgagttgccgtccattaaaatctgatgaccagaggcggattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatacattgatgtactgcatgtatgcaaaggacgtcacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtttgtctgcacagatggcgcgtcgtctgcaagtcacttcagagaaagtgggcaacctggcgttcctcgacgtgacgggccgcattgcacagactctgctgaatctggcaaaacaaccagacgctatgactcacccggacggtatgcaaatcaaaattacccgtcaggaaattggtcagattgtcggctgttctcgtgaaaccgtgggacgcattctgaagatgctggaagatcagaacctgatctccgcacacggtaaaaccatcgtcgtttacggcactcgttaatcccgtcggagtggcgcgttacctggtagcgcgccattttgtttcccccgatgtggcgcagactgatttatcaccccgatatcaactatgcacttcgacaaacgctggtgctatgtttgcccgtggccgttgggttaatgcttggcgaattacgattcggtctgctcttctccctcgttcctgcctgttgcaatattgcgggccttgatacgcctcataaacgttttttcaaacgcttaatcattggtgcgtcgctgtttgccacctgtagcttgctgacacagctactactggcaaaagatgttcccctgccctttttgctgaccggattaacgctggtacttggcgtcactgctgagctggggccattgcacgcaaaattgcttcctgcatcgctgctcgccgccatttttaccctcagtttggcgggatacatgccggtctgggaaccgttgctcatctatgcgttgggcactctctggtacggattgtttaactggttttggttctggatctggcgcgaacaaccgctgcgcgagtcactaagtctgctgtaccgtgaactggcagattattgtgaagccaaatacagcctgcttacccagcacaccgaccctgaaaaagcgctgccgccgctgctggtgcgccagcaaaaagcggtcgatctaattacccagtgctatcagcaaatgcatatgctttccgcgcaaaataatactgactacaagcggatgctgcgtattttccaggaggcgctggatttacaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccaacgcgttttacgatggaaaagcaaattggcgcactggaaaaaatcgcccgccagcatccggataatccggttgggcaattctgctactggcatttcagccgcatcgcccgcgtgctgcgcacccaaaaaccgctctatgcccgtgacttactggccgataaacagcggcgaatgccattacttccggcgctgaaaagttatctgtcactaaagtctccggcgctacgcaatgccggacgactcagtgtgatgttaagcgttgccagcctgatgggcaccgcgctgcatctgccgaagtcgtactggatcctgatgacggtattgctggtgacacaaaatggctatggcgcaacccgtctgaggattgtgaatcgctccgtgggaaccgtggtcgggttaatcattgcgggcgtggcgctgcactttaaaattcccgaaggttacaccctgacgttgatgctgattaccaccctcgccagctacctgatattgcgcaaaaactacggctgggcgacggtcggttttactattaccgcagtgtataccctgcaactattgtggttgaacggcgagcaatacatccttccgcgtcttatcgataccattattggttgtttaattgctttcggcggtactgtctggctgtggccgcagtggcagagcgggttattgcgtaaaaacgcccatgatgctttagaagcctatcaggaagcgattcgcttgattcttagcgaggatccgcaacctacgccactggcctggcagcgaatgcgggtaaatcaggcacataacactctgtataactcattgaatcaggcgatgcaggaaccggcgtttaacagccattatctggcagatatgaaactgtgggtaacgcacagccagtttattgttgagcatattaatgccatgaccacgctggcgcgggaacaccgggcattgccacctgaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacagcgggttattggtcatctgaacaccatgcacaccatttcgtcgatggcatggcgtcagcgaccgcatcacgggatttggctgagtcgcaagttgcgggattcgaaggcgtaatgcaggctaaaccatcggataaggcattcacgccgcatccgacatcttttgcctgatgcttcgtatttacgccccaaccaccttcgccaccgcgtgggcgaaacgttgcatcccttcatcgatatccgcatcttccaccaccagcgacggtgcaaaacgcatcacatccggtccggcattcagcaccattacgccagcctctgcgcccgcatacaggaaatcacgcgcccgacctttgtactgtggtttcagctctgcgccaatcaacagccccataccgcgaatatcgctaaatacatcgtactgctgatcgatcttctgcagatggtcaacaaaacgctggcgtttcgcctgaatgccttccagcacttcaggggtattgatgatatcaaacgccgcccccgctactgcacaggccagaggattaccgccgtaggtggaaccgtgagaaccaggatgaaacgcagaagcaatttccgccgtggtcagcatggcgctaatcgggaagccgccgcctaacgctttcgcagaggtcagaatatccggcgtaacgccgtagtgcatgtaagcaaacaaatcgccggtccgccccatcccgcactgcacttcatcaaacaccaataatgcctgatgttgatcgcacagctcgcgcaagccctgcaaaaactctggcgtcgctgccgtcacaccgccctcgccctggatcggctcaaccaccaccgcacaggtgtgatcatccatcaccgctttcactgcatggagatcgttaaagggaacgtggatgatgtctgccggtttcggcccaaagccgtcggaatattttggctgcccacccaccgaaacggtaaacagcgagcgaccatgaaaagcgttatggaaggcaataattttggttttgaacgggctatgacgcacacaggcgtaatggcgtgccagtttaaaggcggtttcgttagcttccgtgccggagttcataaacaccacgcgttcggcaaacgttgcctcaatcagtttacgcccaagacgcagcgccggttcattggtgaaaacgttactgatatgccacagagtttcgccctgggtttttaacgcgttcaccagcgcaggatggcaatggcccaacgccgtaactgcaatgccacccgcgaaatcgacatactccttgccttgctgatcccagattcggctgccctgaccttttaccggaataaactctgccggagcataaatcggcaggatcacttcatcgaaagtcgcgcgtgtaattgctgtttgttcaattgccatctcatgatcaccctgttacgcataaacaaatgtgaaattataaccacaaaatatgcataaaaaatcactaaatggcaatcagaaatcagcgatgcaggaaattagccagcagttgatgtccttgttcgctaagaatactttctggatggaactgcacaccttccagatcccactggcgatggcgaatccccataatctctcgggtttcgctccaggccgtcacgtcaaagcacgctggtaatgagtcaggttccaccaccagcgaatggtagcgtgtcacggtaagtggatttgccagcccccgaaatacgccctcaccgttatgtgtaatcggcgaggttttgccgtgcatgacctttgcggcgcgcacaactttaccgccaaatgcctgcgccattgcctgatgaccgaggcagacgccaagaatcggcaagcgcccggcatagtggcgaataacgtcaagggagatcccggcttcatctggcgtacaggggccaggtgagatgacaattttttgtggtttaagggcgtcgatatccgccagcgtcaacgcatcgttgcgcttaaccagcacatccgcccccagttcacaaaagtactggtagaggttccaggtaaaagaatcgtagttatctataagcaggatcatggcggctccggtacaaaagaaccgcgctattttactcagattccccggcttcgcttaccactttgctaaatatcatctgcagtgcggtgagatcccccattgccccactctgatttgcctgattccaggcctctttttcgataccctgccagctcagttgatatccggcatgaatcgccagttgctcgaagaagatccgctgtgccagaccacttcccacccggaagggatgcagcacgttgatttcacaatagtaatgcgccagccgctcgacgaacttcgctttctccaggccaaccagataaccttcttcctccagatcctgcatcagggcattgccctctttttcgatataagcaaagtggcagaacggcgtatcaccctgataaatatcaacttcacgcagttgccctgcccagtcgaaaatatcctgatacagctggcgatggatagttcgcaaatgcggtaaaccgcgcaccagcggaccaagctcaatggtcgcagcacgcagcgccgtcatttcgtaagcggcctgttccagccgctgctgctggcggatgttcagccggttacgcatgatatcaaggcctggataaagatacggatcgcgcccttcgccgaatttatcgctcatagtgactcctcagctcttcaaggcgcgctaaagcctctgcggcagtaagagtgactaaaggcatctcgacgccttcaagacggcgactggcctgaaaattacgattacgctgaagctcccagagacgggacttttgcttatcggtgagtttcttcacttgatgcctccctgaacgtgtccatttgccacaagtataagcggcaaatccgggttacgccgggagagcagaagcgcgggcaagattgcccgcgcgagaaatcattacggcaggactttagcggaaaggataactaccggttttgacggcacattctggtacggaccaacgtcatgagtcggcacctgggaaatcttatcggcaacgtccatgcctttcaccactttaccaaataccgcgtaaccgaaatcacgctgaccatggtcaaggaaggcgttatcggcaacgttgataaagaactggctggtggcgctgtctttgtcagcggtacgtgccatcgcgatggtgccacgcgtgttgcgcaggccgttatcggcttcatttttgattggcgggtttggttttttctgctgcatctgctcggtgaaaccgccgccctgaatcataaagccaggaatgacgcggtgaaaggtagtgttgttataaaaaccgctgttcacataatcgacaaagttttgcacagacactggcgctttttgtttatccagctccagttcgatgttaccagctgaggttgtcaacaatacgtgcgggtcccctttcgctgccattgctgcgggagaaagagcagaaagagcgaaaacagcagccatcgccgccagggtcgatttgaacatgagatttccttaacaaacagagcagaaaaaaagcaagtgaagagattctaaatagccttcaagaacaaggccatccctttacctaattttacgtatctgaaatatatgtaacctgacgatcactttttattccgtgatcaaaatcacctcttaaaatgcaatttagcaaccgattgcaataaaacatttaaacagatcacaaaatcacctaaaatcgcccgctcgcggcatatcccgctatgccattttatttttgaacgcaggccaatcatgactaacagcaatcgcatcaagctcacatggattagctttctctcctacgcactgactggtgcgttggttattgtcaccgggatggtgatgggaaatatcgccgattatttcaatctgcctgtttccagtatgagtaataccttcaccttcctcaacgccggcattttaatctctatcttcctcaacgcctggctgatggaaatcgtcccgttgaaaacgcagttacgttttggctttctcctgatggtgctggcggttgccggtttgatgttcagccacagcctggcgctgttctcggcggcgatgttcattctcggggtggtcagcggcatcaccatgtcgattggtacattcctggtaacacaaatgtatgaagggcgtcagcgcggttcccgcctgttatttaccgactccttcttcagtatggctgggatgattttcccaatgatcgccgcgtttctactggcgcgcagcattgagtggtactgggtttatgcctgcatcgggctggtgtatgtcgctatttttattctgaccttcggctgtgagttcccggcgctgggcaaacatgcgccaaaaacggatgctccggtagagaaagaaaagtgggggatcggcgtactgtttctctctgttgcggcgttgtgctacatcctcggtcagttaggttttatctcctgggtgcctgagtatgccaaaggcctgggcatgagcctgaacgacgcgggcacgctggtgagtaacttctggatgtcatacatggtcggcatgtgggcgttcagctttattcttcgcttctttgatttgcaacgcattctgaccgtactggctggtctggctgcgattctgatgtacgtctttaacaccggaacaccagcacatatggcgtggtcaattctcgctctgggcttcttctccagcgcgatctataccaccatcatcaccctgggttcacagcagaccaaagtaccgtcgccaaaactggttaactttgtcctgacctgcggaaccatcggtactatgttgacctttgtggttaccggcccgatcgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaaatgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccggacgtaccgttttttatgacaagctgatcatggcaaccggttcctacccgtggatcccgccaatcaaaggttctgatactcaggactgctttgtctatcgcactattgaagacctcaacgccattgaatcctgcgcccgtcgcagcaaacgcggtgccgttgttggtggcggcctgttaggtctggaagccgcaggcgcgctgaaaaacttaggtattgaaacccacgttatcgaatttgcccctatgctgatggcagaacagcttgatcagatgggcggcgagcagctgcgtcgcaaaatcgaaagtatgggcgtgcgcgttcacaccagcaaaaacacccttgagattgtgcaggaaggtgttgaagcgcgtaaaaccatgcgttttgccgacggcagcgaactggaagtcgactttatcgtcttctctaccggtatccgtccgcgcgataagctggcaacccagtgtggtctggacgttgctccgcgtgggggtattgtcattaatgattcctgccagacttccgatccggatatctacgccatcggtgaatgcgcaagctggaacaaccgtgtatttggtctggtagcacctggctacaaaatggcgcaggtcgccgttgaccatattctcggtagcgaaaacgcctttgaaggtgctgaccttagcgccaagctgaaactgctgggcgtagacgtaggcggtattggtgatgcgcacggtcgcacgcctggcgcacgtagctacgtttacctcgacgaaagtaaagagatctacaaacgcctgattgtcagcgaagacaacaaaaccctgctcggtgcggtactggtgggcgataccagcgactacggtaacctgctgcaactggtgctgaacgctatcgaactgccggaaaacccggattccctgatcctgccagcacactcgggtagcggcaagccgtctatcggtgttgataaactgccggacagcgcgcaaatctgctcctgcttcgacgtcaccaaaggtgatctgattgctgccatcaacaaaggctgccacacagttgcggcgctgaaagctgaaaccaaagcgggtactggctgcggtggctgtatcccgctggtcactcaggtactgaacgcggaactggcgaaacagggcatcgaagttaacaacaacctgtgcgaacactttgcttattcgcgtcaggaactgttccatttgatccgcgttgaaggcattaaaaccttcgaagaactgctggcgaaacacggcaaaggctacggttgtgaagtttgtaaaccaaccgtcggttcgctgctggcctcctgctggaacgaatacattctgaagccggaacatactccgctgcaggattctaacgacaacttcctcgctaacatccagaaagacggcacctactcggtgatcccgcgttctccgggcggtgaaatcaccccggaagggctgatggcggtaggtcgtatcgcgcgtgaatttaatctctacaccaagatcactggctcccagcgtctggcgatgtttggcgcacagaaagacgatctgccggagatctggcgtcagctgattgaagccggcttcgaaaccggtcatgcctatgcgaaagcactgcgtatggcgaaaacctgcgtgggtagcacctggtgccgctacggcgttggcgacagcgtcggcctcggcgtggaactggaaaaccgctacaaaggcatccgtacgccgcacaaaatgaagttcggtgtctccggctgtacccgtgaatgttcagaagctcagggtaaagacgtgggtattatcgccactgaaaaaggctggaacctgtatgtttgcggtaacggcggcatgaaaccgcgtcatgcggatctgctggcggcggatatcgatcgcgaaacgctgatcaaatatctcgaccgcttcatgatgttctacatccgtactgccgacaaactgacgcgtaccgcaccgtggttagaaaacctcgaaggcggcatcgattacctgaaagcagtgatcattgacgacaaactggggctgaacgcacatctggaagaagagatggcgcgcctgcgtgaagcggtactgtgtgagtggactgaaacggtcaatacgccgtctgcgcagactcgcttcaaacacttcatcaacagcgacaagcgtgacccgaacgtgcagatggtgccagagcgcgaacagcaccgtccggcaacgccgtatgaacgtatcccagtaactctggtggaggacaacgcatgagccagtggaaagacatctgcaaaatcgatgacatcctgcctgaaaccggcgtctgcgcgctgttaggtgacgagcaggtcgcgattttccgcccgtatcacagcgatcaggtgtttgcgatcagcaacatcgacccgttcttcgagtccagcgtgctgtcacgcggactgattgcggaacaccagggcgagctgtgggtcgccagcccgctgaaaaaacagcgttttcgcttaagcgacggcttgtgcatggaagacgaacagttttccgtcaaacattacgaagcgcgagtgaaagacggcgtggtgcagctgcgcggttaatgttttaacgggaggcgcaatgcctcccctttttgcatggtcctgtaataatcttcggtatattgcaggacattttttaaactttttgttttattttttgtttttattttttaaaggataatcaaatgtttacagacactattaataagtgtgcggctaacgctgcgcgcattgcacgcctgtcggcaaataacccgctcggcttttgggtcagctccgccatggcgggcgcgtatgtgggtcttgggatcatcctgattttcacgctcggtaatttgctcgatccatccgtacgccctttggtgatgggcgcgacctttggtatcgccttaacgctggtgattatcgccggttctgaactgttcaccggacacaccatgttcctcacctttggggtaaaagcgggcagcatcagccacgggcaaatgtgggcaatcctgccgcaaacctggctgggtaacctggtcggttccgtcttcgttgccatgctctatagctggggcggcggtagcctgctgccggtagataccagcatcgttcactccgtcgcgctggctaaaaccactgcaccggcaatggtactcttcttcaaaggtgcattgtgtaactggctggtttgcctggcaatctggatggcgctgcgcactgaaggggcggcgaaatttatcgctatctggtggtgtctgctggcatttatcgcgtccggctacgagcactctatcgctaacatgacgctgttcgcgctctcctggttcggcaaccacagcgaagcctacacgctggcgggtattggtcataacctgctgtgggtgacgctgggtaatactttatcaggtgccgtattcatgggattgggttattggtatgctacgccgaaagcgaatcgtccggttgcggacaaatttaatcaaactgaaacggctgccggttaattactaaggggtttttacgtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcgattgcagcgacggatgatgacgcgcttaaccagcgcgtcagcgaagccgctgaagctcgtcgcatcttctgtaacgtggtcgatgcgccgaaagccgccagctttattatgccgtcgattattgaccgctcaccgctcatggtagcggtctcctctggcggcacctctccggttctggcacgcctgttgcgcgaaaaacttgaatcactgctgccgttacatctgggccaggtagcgaaatacgccgggcaattacgcgggcgagtgaaacaacagttcgccacgatgggtgagcgtcgccgtttctgggagaaattgttcgttaacgaccgcctggcgcagtcgctggcaaacaacgatcagaaagccattactgaaacgaccgaacagttaatcaacgaaccgctcgaccatcgcggtgaagtggtgctggttggtgcaggtccgggcgatgccgggctgctgacactgaaaggactgcaacaaattcagcaggcagatgtggtggtctacgaccgtctggtttctgacgatattatgaatctggtacgccgcgatgcggaccgtgttttcgtcggcaaacgcgcgggataccactgcgtaccccaggaagagattaaccagatcctgctgcgggaagcgcaaaaaggcaaacgcgtggtgcggctgaaaggtggcgatccgtttatttttggccgtggtggcgaagagctggaaacactgtgcaacgcgggtattccgttctcggtggttccgggtattaccgcagcttctggttgctctgcctattcgggtattccactcacgcatcgcgattatgcccagagcgtacgcttaattaccggacacttaaaaaccggtggcgagctggactgggaaaacctggcggcagaaaaacagacgctggtgttctatatggggttgaatcaggccgcgactattcagcaaaagctgattgaacacggaatgccaggcgaaatgccggtggcaattgtcgaaaacggtacggcagtcacgcagcgcgtgattgacggtacgctcacacagctgggagaactggcgcagcaaatgaacagtccatcgctaattattattggtcgggttgttggcctgcgcgataaactgaactggttctccaaccattaatttaacccgggccagagaattctggccttcttaatgactctttttatatattcagcaaataaaacatagccccttaataaatattatctgctaatgggttatattcaccgttacagcgacttacaaaattaagtcattcgctcactgacgccaattaaatattcctgtatcgttcttaacgagcagtctgcttatattcatataatcaatgaatattaattaatatataatacatagggaatgtaaatgaacaaatttattaaagttgcactggtaggtgcagtactggctacgttaactgcatgtactggtcatattgaaaaccgtgataagaactgctcttacgactacctgctgcacccggcaatttctatttctaaaatcattggcggttgcggtcctactgcacagtaagtctctgacagaaatcggctaacaccggtttaattgcccgacgccctctggattttccgagggcgtatttgtttctatgtccttcttgcccccgcccgtaaaaatattttcactttaaattcaatttgataactacatccattagccacagcgcgatcctgtgcgaaattttgtgatcttcctccacattacataacatcatatgttgttatattcatcatgcattgtcatgttaccttttaaatgactgcaaactctcccctacaacgtattggacaagaaaaaggtatcgctatgggaagccaggaactccaacgcaagctcggattttgggccgttcttgcaatcgccgtcgggacaaccgtcggctccggtatttttgtatctgtgggtgaagtggcaaaagcagcgggcacgccgtggcttacggtgctcgcgtttgtcattggcgggttaattgtgatcccgcaaatgtgcgtctatgcggaactatccaccgcttatccggaaaatggcgcagattatgtttatctgaaaaatgccggaagccgaccgctggctttcctctccggctgggccagcttctgggccaacgatgcgccgtcattgtcgattatggcgctggcgattgtcagcaatcttggctttttaacgcctatcgatccgttgctcggtaaatttatcgccgccggattaattatcgcctttatgttgctacacctgcgctccgttgaaggcggcgcagcgtttcagacgctaattaccatcgccaaaattatcccgttcactatcgtcattggccttgggatcttctggtttaaagcggagaattttgccgcccctaccaccactgcgattggcgcaacgggcagctttatggcgctgctggcggggatctctgccaccagttggtcgtataccggcatggcctctatctgttatatgaccggcgaaattaaaaaccccggaaaaaccatgccacgagcgctgattggttcctgtctgctggttctggtgctctacaccctgctggcgctggtgatttccggcctgatgcccttcgacaaactcgccaattctgaaacgccgatttccgacgccctgacctggatccccgcactcggcagcaccgctgggatctttgttgccatcacggcgatgatcgtcattcttggttcgctttccagctgcgtgatgtaccagccgcggctggaatacgcgatggcgaaagacaacctgttctttaaatgcttcggccatgtgcatccgaaatacaacacgccggatgtctccatcatcctgcaaggggcgctggggatcttcttcatcttcgtttccgatctcaccagcctgctgggttatttcaccctggtgatgtgtttcaaaaataccctcaccttcggctccatcatctggtgtcgtaaacgcgacgattacaaaccgctgtggcgtactccggctttcgggctgatgaccaccctcgccattgcgtcaagcctcattctggtcgcctcaacctttgtctgggcaccgattcccggccttatctgcgccgtcatcgttattgctactggtctgcctgcttacgccttctgggcgaagcgtagccgccagctcaacgctttgtcgtaatgttatctggagaaaataaaatgttggatattgataaaagcaccgtggactttctggtcaccgaaaatatggttcaggaagtggaaaaagttctcagccatgacgttccgctggtgcacgccatcgtggaagagatggtgaagcgcgacattgatcgtatttatttcgttgcctgcggatcgccactcaacgcggcgcaaacggcgaaacatctggcggatcgcttttccgatcttcaggtctacgccatttccggctgggagttctgcgataacaccccgtatcgcctcgacgatcgttgcgcagtaattggcgtttctgactacggtaaaaccgaagaggtaatcaaagcgctggagctgggccgggcctgcggcgcactcactgcggcgttcaccaaacgcgcggatagcccgattacctcggcggcggaatttagcattgattatcaggccgactgtatctgggaaattcacctgctgctctgctacagcgtggtgctggagatgatcacccgcctcgcgccgaacgcggaaatcggcaagatcaaaaacgatctcaagcagttgccgaatgcgctcggtcatctggtacgcacctgggaagaaaaaggccgccagcttggtgaactggccagccagtggccgatgatttataccgttgctgcgggtccgctgcgtccgctgggttacaaagaaggcattgtaacgctgatggaatttacctggacgcacggctgcgtgattgagagcggagagttccgccatggcccgctggagattgtcgaaccgggcgttccgttcctgttcctgctcggcaatgatgaaagtcgccacaccaccgaacgcgccattaactttgttaaacagcgtactgacaacgtgatcgtcatcgattacgccgaaatttcgcaagggctgcacccgtggctggcaccgttcctgatgttcgtgccaatggagtggctctgctactacctgtctatttacaaagatcacaacccggatgaacgccgctattacggtggtctggtggaatattaatccctctcccggcccggcaacgggccggatttacgcaaggagttacccgatgaaaacaggtatgtttacctgcggccaccagcggctgcctattgaacacgcatttcgtgatgcaagcgagctgggttacgacggcatcgaaatttggggcggtcgcccgcacgcgttcgcgccggacttaaaagcgggcggcatcaaacaaatcaaggcgctggcgcagacgtatcagatgccgattatcggctatacgccagaaaccaacggctatccgtataacatgatgctgggcgatgaacatatgcgtcgcgaaagcctcgacatgatcaagctggcgatggatatggcaaaagagatgaacgcgggttatacgctgatttccgcggcccacgcgggctatctcacgccacctaatgttatctggggacggctggcagagaacctaagcgaactgtgtgagtacgcggaaaacatcggcatggatctaatcctcgaaccgttaacgccgtatgaatcgaacgtcgtgtgtaatgctaatgatgtgcttcatgcgctggcgctggtgccttcgccgcgcctgttcagcatggtcgacatttgcgcgccgtatgtccaggcggaaccggtgatgagttatttcgacaaactgggcgataaattacgtcatctgcatattgtcgacagcgacggggccagcgacacgcattacattcctggagaaggcaaaatgccgctgcgggaactgatgcgcgatattattgagcggggctatgagggttactgtacggtggagctggtgacgatgtatatgaacgagcccagactctatgcccgccaggcgctggaacgctttcgcgcgctgctgccggaggatgagagatgaaaaccctggcgacaatcggcgataactgcgtcgatatctacccgcaactgaataaagcgttttctggcggtaatgcggtcaatgtggcggtgtactgcactcgctacggcatacagccgggatgcattacctgggtgggtgacgatgactacggcacaaagctgaagcaggatctcgcccgcatgggcgtcgatatcagccatgtccatacgaaacacggcgttaccgcacaaactcaggtggaactgcacgacaatgatcgcgtttttggcgactacaccgaaggcgtgatggccgactttgccctgagtgaagaggattacgcctggctggcgcagtatgacattgtgcacgcggcaatctggggacatgcggaagacgcattcccacagctgcacgctgcgggcaaacttaccgctttcgacttctccgacaagtgggacagcccgctctggcagacactggtgccgcatctcgattttgcctttgcctccgcaccgcaagaagacgaaacgctgcgtctgaagatgaaagcgattgttgcccgtggcgcaggaacagtgattgtcacgctgggtgaaaacggcagcattgcctgggatggcgcgcagttctggcgtcaggctcctgaaccggtgacggttatcgacaccatgggtgccggagattcgttcattgccggattcctttgcggctggtctgcggggatgacattaccgcaggcgatagcgcagggaacggcgtgcgcggcgaaaaccattcagtaccacggtgcctggtaggtataacgttggcgtgagcatcttcacgccaacgtgctgttacttgccggaaaacgaccctataatccgagtaattcattctttatttcagggtcgattatgtcagctacggaccgctactctcatcaactcctctacgctaccgtccgccagcgactgctggatgatatcgcgcagggggtttaccaggccgggcaacagatccctaccgaaaacgagctttgtacacaatataacgtcagccgcattaccattcgcaaagccatcagcgacttagtggcagacggcgtactgatccgctggcagggaaaaggcacctttgtacaaagccagaaagttgaaaacgccctgcttactgtcagtggttttaccgattttggcgtctcacaaggcaaggcgacgaaagagaaagtgatcgaacaggaacgggtcagcgccgcgccgttttgcgaaaagctgaacatccccggaaacagcgaagtgttccatctctgccgggtgatgtatctcgataaagagccgctgtttattgatagttcatggatcccgctgtcgcgttatcctgactttgatgagatttacgtcgaaggaagctccacctatcagttatttcaggagcgttttgacacgcgagtggtcagcgacaaaaagaccatcgatatctttgccgccacccgcccgcaggcaaaatggctgaaatgcgaactgggcgaaccgttgtttcgcatcagcaaaatcgcctttgatcagaatgacaaaccggtgcacgtctccgaactcttctgccgcgccaatcgcatcaccttaactattgataataaaagacattaaccgtaggccggataagatgcgccagcatcgcatccggcgatgctggcgcgttgaattttacatcccgtacgttcccctcaccctaaccctctccccaaaggggcgaggggaccgttcagtacggaatttagcttgacggtgctatccagcattaaatactggcaatactctcacgcaaaatccgcagcaccgtctcttcaccgctgcgattcgggttaatgcgaatcgcacaatgttctgattgtggattcgcctggcgaaacgttccggaaaggcgataaaagagcggcgggatttcatatttcgactctgcacccaccgggtaaggcaaggcaccgcgcttttgcgcctcttccagcactctggcggcaatcggctgatgaaactcgacaatcaacaccttcgactgcgcattagcaatcaccgcgcttttcacttccggcaccgcaccaccgttaagcaaagccagcaaccgttcagatacccctgcctgcaccgcgtgcatcactggcgcaaacaccagaccacgcaatacttccagcgcctgtgcgccctggatctggctaccgccggagtaaagcgtggcgcgaatacggttgataacatcagcatcgccgaccactgcaccaacaccctctggcccaaatagcttgaagcaggaaaatgtcgagacattcgcgccgcattcacagccgattcgagccaccttcatcaccgcatagttgtcatcggttaacgctggaacacctgccgcgcgcaacgttgccagcacatctgccagcacgtagctgtcctgcggctgctggcgcgtatgctgcaccagcgccgcatccggttgttgctcgtcgacgacctgcttcagtgccgacaggtcattgaaatcaacagtaataagcgtcagccccatctgctcaataataacccgtgtcgtcgggtaaacaggcgcgtcatgcaccagaagacgctgccccggtttgagcaaagccgccagcccggcgcgaatcgcgccagtccccgcgccctgcaccagcgccgcagcctgtgcgtgaaatgcatcagccagcacctgttccacacgctgggtaacgcgcggttgattcagtcctggcgttaagcctaaatcaccgccagtaagaaactcgctgccggggaaatggcgacaaatgctatccaccagcgcaaactgcttttgctgcgcctcaataatcgtcaggctttgcagaggaaacgtcttcataggtgccttccttaagccggaacgaacaggccaagccagtaaagaacattcagcagaataccggtgatcattactgccacgaccggtgccgccattttctgtaccggacggcccagggattcgttgaggaagtaaatggcaaccgcgatagagaatccggtataacccgccatcttaattgctgcgaaaatcgaaccgaccagcagcgccacttccatcagcatattcatggcgttacggatgttatccgacgcattacgcaccgacgggtagcgtcccagccatttgccgatcgaacgaagcagcaagacttccgccgaaataaccactgcgcctaataccgctgcaaccatcggattcggcgagagatagtccaccgcataaacaaaggtaaagcccgcaactgcatacacacccgttgctaacgcggtggtggcaatcaacggcacaaaccccagtccgcgcataaattctgccagagccgcctgattaatcagcgtttgcgattgttccggcgttacgcctgcggaatatgctttctccagtgtgaagatcgacacttcactgccagcaaaaatcttcatgctggcaacggcggcaatcaatgctcccacgatggcgatatagggtaagtttttgataatccgtgacgtgcgttcttcaaacaccgaaagcccgctggcatcaatgtcattttcatcacgatgacgcaggtcgtgagttatcgcgatccccagcagcatcaccatgccaataaagatttcgatggattcagggttaagatgtgggaaatagcgcacgactaccacacgggtcatcagtaccaccacggcggcgatcagactttgcttccagccaaactggtagaaaatcgccaccagcgggaacagtgcaaaagctgaaaccaccggcgagcttaattcccccaggctacctaatacatccaccggcagcgcggtcagcagctggtttactggcaacaggcaagtaaggatcaacacgccccagatagcgccaagaccaaacgccatcaggctgtttatcgccaggacgccgaggatatcggtaggaagaaagagtaaccatgcgttgagcagcccggttttcagggtaaaagagatccccaccgaggccacaaaaccaatgctcagaccaaaagcgatactccccgcctcgcgacggttcatatagccttcaatcagttgcggcaggatcgggcggatgccgtcatgaaaaacagccgccgagcgatgcgccagaagcgatgtcatacccgtcaggcacgccaccacgataatctgaatatacagatccatagtcgtgccttttatttcagatggttaatcagcatcggaatcgcgtgttcgacgtgctcaacggaaaggccaaacgccacttttccttcagcgatcattttggcgatatgctcgtctttcgctttaatgcctggtttggcaatggtgcaacttttgttatagcctatcaccgcgatggcaatcgacaatgccgcgcccgcaccggtattacacgcgccgatgtaataatccagttgcccggatttcaccttcattgccgcttccatgtcgttgtgaatgaaaacttcaaaacagccaggagccgtcgcttcaatagtttttttaatctgctcacgctgtaagcctgcaacgccaatctttttcatgagtctgtccttattggaaaaattgagagggattttcacgtaacatcacatccacatcggcctgactgaatcctgactggcgcaattgcggaataaaggtggttagtaaatagtcatagccataaccaccgttggcttttaaatgggagcggcgcgtaatatccatcgacagcatgacgcggttcagcaacccacggtcgcgtagcgcatgaagcatcgcaatacgcttttcgtccgggtagtaactgttcttgccgatggtgtcgaactgcacgtacgcgccgagatcgatcatcttcaaaatgttgtcgaggttgtctttcagatcgcagtgaccaacggtgacgcgcgaaagatcaaccccgtgggcttgtagcaacgccagttgctccagccccatcgtgctgaacgacgtatgcgtggagatcgggcgtccggtctggttatgcgccagcgcagcggcaataaataccttctcttccagcggcgtaatctttccttcgctggtgccgatctccgcgatgatcccggctttcagctccgtgccatcgataccctgttcaatttcatcgaccatctcctgcgccagttcctgcacgctgcgggtcgccacatgttccgggaaaaacgcgtcctggtaataaccggtacaggccaccacgttgatccccgtctcgcgcattacatcaagcataaattgcgcattgcgccccatgtaacggttggtcatctcaatcacattacgcacgccccgggtcatcaggtcgttcatctcctggcaaatgaacgcatactgatcaaggcggcagtccacgttgtttttaaagccggagagatcaatatgcagatgctcatgggcgagggtgtaacccgtcggatcaaaactcatagggtgtctcctgcaaaccggagggaggaaagaaaagagcgaccattttgtggcggtggcgcgcggaaaaattcacacacggtagcccccacatcagaaagcgtggtgcgcacaccgagctgcgtagcgatcatcccttgctgataaaccagcactggcaccacttcgcgggtatggtggctgtgaccaatggtcggatcgttgccgtgatccgccatcacgaccaggcaatcatctggctgcatcgcctcaacaagccgggcaaggttacggtcaacgacctgcaaacgttcggcataacgtgcgacgtcttctgcatgaccagcgaggtcggtttcctgaatgttggtgcaaataaacgccgtcggatgggtgttaaattcgttgagggtgatatccataatccgctggctatccaccagattttgccagctcacgccataaggattgttgacgatatctgccaccttacccaccagcacggttggcacgcctgcttcatacagtttttgtggcacctgcactttttcatcgacgccatagcccatatgcacgacctggaaaccgttgtcataagcgccagaacgcggcgcattgataccaataaagcgcccttctttgctttctgcggcatcgagaatgcgttgactgtcggttaacaggccaccaaatgtaatgacccgaccgacctgtacctgctcacgcacgatacgaccaattttgattgcgtcgtcaaaagagatcacagagagattggcggtaatgttatagacctggcctaaatccgcctcgagattatcgccaatcgcaaccgcctgattgacccacagaaattgcagatcatcgccacggcgctccacctgccagccagcggaaactaatgcctgctcaacacggtcaatcacatcgcgaaaaggcatccgcagcggcggtaacgggcgcgtgcctaaaatttcctgatgccccataaaggtatcgccaccttcatgttgcagctctgccacgccccaggttgcggaatctgacggctgcatatcgcctggcgcataacccaatgcgttgattagccccagcgtctccagcgttggtagctgcaaatgcggcaactggctcaggatgtgaccacatgtattcgctcccgcatcttgcggacgcaccagcgtgacatctttcattgcccctacgccaaagctatcaatcactaacaccacaaatcgcgccattacgcccccagagagtttccaagactgtcataacgaccgacgatttccggttcgccacgatgaataccggacaccagcaccacatcgctacgggtgacaaaaatctgcgtgcgaaaacagagcaccactgcactgcttaccggaaactcgcctgccagcggcagggtgtagtcgatactgctgtcatccacagttttgagattggtttcagtaatcttttgattttctggcgtaaacaccaacgcatgttgcgcatgaccacgacgatagtaaccgccgccgtagcagtagctgtcgccacggaaatgatgggagatttcacttaaccagagcatcgcgatacgttcaggctgatcgccctgctggtttgccggaatagtgcccgtcagcgcatgaccgggttcggcatgagtcacaccgtattgcgccagtaatggcagcgaagtgcagctggtcgctgaaggcgcgttcagttgctcaagtgcaataccagatttcgccagttgatcccgtgcctgtatcagcgtgtgaagattcggtgtcggcaaaacttttccgacagcctcatcccaaagcaggcaagggaaatgggtaagtccggctaaatgcagccctggcagattctggatttcggcgacaatctccggcaacaccttgagggcaaaaccgctctcctggcccggataaagaaaatcatcgtcgctataaactttaagcagcacagactggattcgcccggccttcaccgccgccgcagaaacttcccgcgctttgtcgagagtaaacacggtgatgacgtcggtgccctgttcaacggcgtcagcaacctgatgacaagggatttgtaccagatgcccctgatgcgccacaggcaaaccagcgcggcgcatgactcgcgcctctttgtaatccaccgccacaatgccgctgtagcctaatgccagcaatttttccgccagccacggattacgaccaaactgcttggtcatcagatacagttcaatgccgtaaagccgcgccgtctcaatcagccgcttaccgttttccagtatctgatccacgtcgatcacccagctgtccggggcgatcttgccctgctgccacaggcttagtgcggcggaaatcagcgccgggttctggcgtttcaatgcttctacaaacatcttgttgcctcgtttctgttccttgaattaaatattcatttttttgaatatttaggttgtgcgacgtggatttgtcgggagcttcaaacctcttcgttagcagccatccataatccataaaggttggccagcaaatagccttcttcacacgggttaacttccagtgcgaattccttcaacaacacctgatgcaattgcacaacggcttgccagtggctggattgcgccagttctgccagcaactcgttatccagcggctctatttcttcaccacggcgactgcgcatcagtgcactcgccatatgtgtcatcgccatcgttccttgctcactgcgcaccggcagatggcactctgtttccagtacgttgacgacctgcatcatgcctttgcagatgtccttatcaataacgcctgcctcgcaaagcaggttgagtctggtttccatatcagatgcctttcgtttaataactcggttcctgttccccactcactacccgttgttgatgggcgagcagggcgtgtttatctacaacggcacgcagcagttgttgcattgggtaatcatcgactcgcgtcaggaccacggcttcggtggcctgtaaaaatcgcggatcgtctgtgagcggcgtcgcctctaatcccagcatggtcagttcgttttccgccaccacgttccagatcaccgcatcgacatcgcctttaacaatgcgttgtaaactctcgtgataagagagatcgactcgttccacatcactaccgccaaaaaaaacatcggtcatgattttctgatccgccgaacggttatccagccccacgcgcttcacgtttgcggactcgcctttacggcaaatcaactggtgctcgccaacgtaggtgtgcggccccaactccagcgcgaggcataagcctttttgcgtgagataactttccgccgctagtcgcgaaaccaccgccatgtcatacacgccattaagcagacactccacgcgaatatccgcgccacgcatgtgcgcatagtaaaaaggaatgccatcaaactgggctttcaatccgctcgccaggccttcgtacaaacgggtatagggcaagggcattgcacataccacgttgttgatatccacatgagtcagcaatgctttgttatccatctcgaccagataactgccattgcgcccacggcgttcaatccgtatcgctccgcttgattccagcgttttcaacgcggcctgcgtcaggccaacggatgaacggcattcatttgccagctcatctatggttttcaatcgattaccgcacttttcacccaacaaataacgggccagcgtcgtgatgacgacgccttcttttttgataaacgttcgacgcataataaattttcagtaaattgaatatttatatcttcaggaatttgaagataaggcgcaacagcgagatgtggaaacggcgaggcacttcacattttttcggattattgcaaatgaggataaaaaaaccgggtttccccggtttcagagtgatgataaaagcaaaattgcctgatgcgctacgcttatcaggcctacatttccttgcaatatgtgcattactttgtaggccggataaggcgttcacgccgcatccggcatgaacaaagcgcaatttgccagcaatagtgaattacggcttcgccacaaaaccaatcgcttcgtacaccgcttttagcgtacgggaagcgtgcgcgctggctttttccgcgccatctttcatcacctgttgcaggaaggcttcatcgttgcggaaacggtgatagcgttcctgcaattcagtcagcataccggaaacggcatcagccacttcacctttcagatgaccatacatcttgccttcgaactgtttttccagttctgggatgctctggcccgttaccgctgaaaggatatccaacaggttggaaacgcccgctttgttctgcacatcgtagcgaactaccggcggctcgtcggagtcagtgaccgcacgtttgattttcttcactaccgatttcggatcttccagcaggccgataacgttattgcgattatcgtcagacttggacatcttcttggtcggctccagcagcgacattacgcgcgcgccagatttcggaataaacggctccggcaccttaaagatctcgccatacagcgcgttgaaacgctgggcaatatcgcggctcagttcgaggtgctgtttctggtcttcacccaccggtaccagattagtttgatacagcaggatgtccgctgccatcagcaccggatagtcaaacagaccagcgttgatgttctcggcataacgcgcagatttatctttaaactgcgtcatgcgactcagttcgccgaagtaggtatagcagttcagtgcccagcctaactgtgcatgttccggcacgtgggactgaacaaaaatggtgcttttctcaggatcgataccacaagccagatacaaggccagcgtatccagcgtcgctttacgcagcttctgtgcatcctggcgcacggtgatcgcgtgttggtcaacgatacagtaaatgcaatggtagtcatcctgcatgtttacccactgacgcagcgcacccatgtagttaccaatggtcaattcacctgagggctgtgcgccactaaaaacgatgggcttagtcatttttcgattcctgattttcgctatgcggaagccctaatgcgggcagaaggtcatttatagactgataaattacatcaggctggctgagatcgatagcctcgccgtagttatatccgtaggttaagccaactgatgggcaacctgccgcttttgccgcctgaatatcattgcgtgagtcgccgacaaacagcatctgttgtggggcaattcccatccgctcagccaccagtaacagcgggtccggatgcggttttttgttttgcacatcatcaccaccaatcaccacgctgaagtatttggcgatatctaaggcttcgagcagcggcgcgacgaacggcgtcggtttgttggtgaccaggcctagcggcaggcctttagcctgcaacgcgcccaacgtatcggcaacgtgcgggaacaaaaacgtcccctcttcggcaacctcgccatagtagcgatcgaacagtttacgcagaatacgtacctgttcttctgccggaatgtcgtcatcaacgggcggtttacccattgttttacgctgagtcgcacgttcctgacgcgcccaggtcaatgcgcgctccatcagaacatctgcgccgttaccaatccaggtaataacgcgttcttcacctgcgacgggcaactccagcgcatacagcgccatatctaccgcagcagcaagaccaggagcactgtcgaccagcgtaccatcaagatcaaaagcgacgccgcgaatatcttcaaacttattcatgacttacctttgccagttcactgcgcatttcatcaatgacttttttgtagtctggctggtcgaagattgccgaaccggcgacgaacatatccgcgcccgccgcagcgatttcgccaatgttgttcaccttcacgccaccgtccacttctagtcgaatgtcaaagccagactcgtcgatacggcgacgtacttcgcgcagtttatccagtgtttgaggaatgaaagactgaccgccgaaaccagggttgacggacatcagcaggatcacatccagcttatccatcacgtaatccagatagctcagaggtgtcgccgggttaaataccagacccgctttacagccattttctttaatcagttgcagcgtgcggtcaacatgctcggaggcttctggatgaaaggtaatgatgctggcaccagcggcagcgaaatcaggcacaatgcgatcgacgggtttcaccatcaggtgtacgtcgataggggcggtaatgccatagttacgcaaggatttcagcaccattggcccaatcgtcagattgggaacatagtggttatccatgacgtcaaaatgcacgacatcagcgccagctgccagggcttttgcggtatcttcacccaggcgggcaaaatcagccgacagaattgagggggcaatcaaatactgtttcatccgcttctccttgagaattattttttcgcgggtgaaacgactcctggtttgtacaaagccagcagttcgtccacctttttacgtgtgccgccgttgctgcttatactgcgtcgaactttgacgacatgcaattttgcgcgctgataccactcacgcgttaacatcgtatcgtgattggagatcagcactggaatatggcgctcaaccagaccttcggcgatctccgccagatgcgcttgttgttcaagcgtaaaactgtttgtgtgatacgccgtaaagttggcggtcgcagacagcggtgcataaggcggatcgcaatagacgacggatgcatcatctgcgcgcgccatgctatcggcgtaagactcacaatagaaaaaggcattctgcgctttttcagcgaagtgatacaactctgcttccgggaaatagggttttttgtagcggccgaacggcacgttaaactcaccgcgcagattgtaacgacacaggccgttgtaaccgtagcggttcaaatataaaaacagtaccgcccgacggaacggatcctggcttttgttgaactcttcgcggaactgatagtaaacctcggcgcaatttgtttcgggaacaaacagctcgcgtgcggcctgtacgtactcatcagtacgcatcttcacaatgttatagagactgatcaggtcgctattgatatcggcaaggatataacgagaaaagtcggtgttgagaaacaccgacccggcacctacaaaaggctcaaccagacattcgcccttgggcaaatgccgtttaatatcatcaagcaggggatacttgccccctgcccacttcaaaaaagcgcgatttttcttcatgctgactaactaattacaccttctccggctgtggagaaagctccgacagcatccagcgcttcaggcaactcccgcaacgataaaccattgcgggagataaccttgattacttcagatcggcctgtacctgacgcagcggtttcgcccacgggtttttggcctggacatctgctggcaatgtagataccgcttttttcgcctcttctttcgaagcgtacacgccagaaaccaggacataccacggctgaccattacgcgtcgtttcatagacaacgtagtttttcagattctctttcttcgcccaaccgttcaggttgtcgtagttagaggaactgctcagctgcagagtgtaatggctggacggtgccgatttcaacgaaccaacattacctgcggtcttcgccccagcagcgggtgttgctgtggtttgcgccggggatgccgtctgtactggagccgtagtcgccgtctcttttggtgctggcgtagaagtcgcagccggtgccttcgtgctcgccacaggggcagctggttcagtacgcttcggcgtctgtgctaccggcttcggctccgttttcacggttgcttgcggttttttcggttcaatcaccgcctgctgacgagctgggcgcgtagtggacggacgttcagcggtttgcgttttcgccgtgtcacgcgatgcattgccattgcgaacaggcgcaaccgttgcgggttcagtcggcaacgtggaattgaccgccacattgttcagctgttgctgattttgtggctgggtcagcgcattgttcaggtcaccctgcacttcaacacgttgttgaccatccgttgccaccggggtttgcccttgagtcggcgtagaagagatcggtggcagagaaacatcctgctgagtattttccgcagacgtggttcccggcgctggctgcacgccattcgcctgatcggtcgcattgccagcaagatcaatactcttctcgccagacgcggtttgatcgctggaagtggtcgagggggcttttagcgcagaaccgataccgatgatcaacagcagtagaaccagaatgccgacgcccatcatcatatactgacgagaagcgggtttactggctgcttttttgcgcttacgcggacgacgctctacgcgctcttcatccacggtttcatcttcggattcgtcaatttcttcttcgatttccggttcctcattgcgctctttttgcgcacgagtcggacggcgatcgtcagtgtcatcaagttcaatatcatcaaaattgatctgcggttcgccacgttcagtacgctcagaacgttcagaagattgacgagaacgaccagtacgacgatcgctgggatcgggtttcagctcgtcttctggtttgaattcatccatttaacaccccactaaaaggttaatgcttaccacgttgcaattaacctgaagctaatagaccgcttgataagcggcctgacctttcttgttgttacgctgattgacaatcggcaatggcgttaagaacaagctcgtgcgaaacgccgctgcgaacttcactcttaccaattgccaacggaagaattaagcgcatctctcccgcaaggactttcttgtcacgcagcatatgcggtaaatacgcctgcgcggacatttcgcgcggcccattgaccggtaacccagcccgcttgagcagggttataatacgctgcgtttcggcagaactaaactgcccgagacgttccgacgtccgcgccgccatcaccatacccgcagcgaccgcttcaccatgtaaccaattgccataccccatttcagcttcaatggcatgaccaaaggtgtgtcccagattcagtaaagcacgtaacccggtttcgcgctcgtcggcggcgacaacttctgccttcagttcacaacaacggcgaatacagtacgccattgccggaccgtccagacgcaacaacgcatccagattctcttccagccagttaaaaaacgcaccgtcaagaataatgccgtatttgatgacttctgccagccccgacgctaactcacgcgggggaagcgttttcagacagtcgagatccaccaccactgaagcaggttggtagaacgcgccaatcatgtttttaccgaggggatggttgaccgcagttttgccgccaacggaggaatcgacctgcgacagtaacgtcgtcgggacttgaatgaaacggacaccgcgctgataactcgccgccgcgaagccggtcagatcgcccactacgccgccgccaagcgccaccagcgtagtatcgcgaccatgcggtttttgtaacaacgccgtaaagacggtatcgagtacagccaggcttttatactgctcgccgtcagggaggataacgctatcgacgttaacacccgcctgttcaagtacgccgcggaccttatcgagatacagaggagccagggtttcgttggtgaccaacatgacctgctcgcccgatttcagcggtaagaatgaagctggttcattaaacaaaccagatgcgatggtaattgggtaactacgttccccgagagtaacgacaatcctctccataacgcgacatccaccttaattactgtacccgcagacgagtgtatataaagccagaattagttgctttccagcatgtgaataatctggtttgcaaccactttagcgctttgatcatcagtacgaatggtcacgtcggcaatctcttcatacagcggattgcgttcattggccaacgcttccagaacttcacgcggcggtgtttcaacgtgcagcaacgggcgttttttatcacgctgcgtgcgtgcaagttgcttttcgatggtcgtttcaagataaacgacaacgccacgagcggaaagacggttacgcgtttcacgggatttcacagagccgccgccagtagccagcacaataccctgtttctcggtcaactcattgatgaccttttcttcgcgatcgcggaagccttcttcgccttctaaatcgaaaacccagcccacatcagctccggttcgtttctcaatctcttgatcggaatcgtaaaattccatattgagttgttgagctaactggcgcccaatagtgctttttccggcacccataggcccaaccagaaagatattgcgtttctctgccattttttcggtactactaagactattcgttaatgataaacccgcttcgctcagagagcgccgcaggacatgaactgaaacctcataagatattgcgagagtcagactgaaaattatctcaatactccagcgggtttggcaactgaataaatcacccatccctctgcatatctggtcgctgcaagcgcgctgccttgctaccaccgctctggcgataaatcaccgggtaagattagcgtaaaaaagacagcaaaatgccgcctgaatgataaatcatcatcatggaacgcaggcagcgaagagcaccaactctcaaatcggtactccttgtatgctaaatacctgcgcgcgtcaaatagatgaaacacgttcagcgtaaaaacattaccgcttttacggctgtttactcactggaaaccagtcgtggcgtgataaacaccactaactcgcgtcgttcatcttcttttccgtcatgacgaaataattgcccgaaccagggaatgtcgccaagcaacggtacgctatcctgacccgatttatttttacgggtaaaaatgccgcccagcgccaacgtttctccgcttttgacctcgacctgcgtttcgatctcctgcttatcaatcgccagcacttcgccatcggcctgctgtagcacctgccccggaacgttctggctgatgtgtaatttcagccggatgcgacctttttgtaacaccgtgggcgtgacctccatccccaggacggcctctttaaattccaccgacgtcgcgccactttccccgctggaaacctgatatggaatttcgctcccctgtttaatgctggcaggctgaagatgtgaggccagcagacgcggactggcgataatatccagctgctgtttttgttcgagcgcggaaagctcaagatccagcaagcgtccgttgatgcgcccaatgttaaaaccgacatgcgttgtcgccgtcgctacggagaggtcgctaccaagcgtggtgacttgcccaacgccaccagcgtgttgcgcatcggccagcgtccatttcacgcctaactcacgcaaacttttttcattaatggtgacaatatgcgccgacagctcaacctgcccgaccggcagatccatttgcgctacccactgttcaagcgcgcttaacgccgttttgttatctcgtagcaaaaggcgattggtgcgtttatcgacggtcatactccctttggcactcagtagcttctcccccgctttcgccagttctcccgcgtcggcgtattgcagggttatactgcgattttccagcggcagatttgcctgcgcccgcgcctgctccgcctcctggcgggcgatattgttattctgccaggcaatggaatgcactgagagaatgttgccttcctgccgcgttatcagtccggcgcttttcactacagtttgtagtgcctgcttccagggaacatctgttagatgtaacgacaccgtaccgctgacgtctggcgacacgaccaggttcaacttctcctgttcagccagcgcctgcaacacctgagctaccggaacgtcatccaccatcagcgtcactttttgcggctttgccgcctgtacgccgggtatcagcatcaacagtagtgcggctatccattgcttcatttgtatctccttgccgttgccacaaccattgtggcggttcgcagtttgtcccggtacccagcgttagtacgtctggcgtcagctgtaaaattgtccagccgttttccagcacatcgttttgctgcacccgtcgccatttcttttgcccgtcttttattacaccgatgatgcgctcgcctcgccctaccatcccctgatagcgccactggctaagttcgctaatccggcatagatcttccggcggtttaaaagggtcacgcataccggttaaaaggcacaatgcaatacctgccaacaaccagcgtttaaccctcatgcggcgtctccagttgtagcgtgaacaaaagatcatcaccttccacgcttaacgaaaaacggctcacgctgacgttgcgctctgccagccgtgtaaatgccgacggcactgcttcccacagcgttttcaacgccaactcgcctccctgcgcggatggatgccaggaaaccagttgcgcgccggataactgaaaatccagtggcgaaaagggcagcgttttttcctcgctgaagggagcggtgtctaccaggcgatacagtgcggcccactgctggtgatgacttgcccgtagtcgaattaatgcgtcgcgctcttcatggtgtgtcgatgacagaaaaatgagcgtaactaacatcagcaaccagaatgcccagcaaagctggcggaggcggggtgatgtggcgaaccaccagtcaaagaacatgttcatcgctaaccttccttgttaactgatactcaaattgccagcgtccctgcgcatcctgctgcgtggctccccgctgattgagatgaaaagatgcatcctggcggagtgacgtttctagtgcgtttaacgcggtaatgcttgttgtcagccccttgatctccagcgttccctgctgccagcttatcgttgtcagccaggcgtgctcgggtaaaagcgccgccagtgcttccagcgcagattgccagtcgcgggtaaattgtcgctggcgctgccgttgcgaacgctgttcgcgtaactgctgttgctccagcaaacgtggcttcgttatctgtaagctgcgggcgagttgttgttccgcctgaagcaaaactgcgtctatgcgcgcttcggcgctgcctgtcagacgcagtattagcgttatcccgacggccagcagcagaggcgcaacgaacatcagcaaccagaaacgcagaaaagcggtccggcgttgctgtcgccagggcaaaaaattaattggcgggttcatcagtacgccttcccaagcgccagccccagcgcgatggcaaagtctccacctggcggcggtagcggcggctgacgaacagaaacggcctcccagggatcaaatccgccttcgccacatatcgcgacgctttcgggatcaacggataacgctgccgccagctccttcgcgctagtcatccccaccgccagtttgcgcccccagctatagcgcgtcgcccacagccactgttcgttatcacgccaggccagacattgctgatgagaaggtaaaaaaggcaggaatcgctgtaatgcactggcatccggggtgatcgcgctcacatgaacacgcaacctttctgccagagtaagcagcgttgccagctctttgctttgcgcggcagtcacgttataggcgggactgagtgagtcttcgctgtaatcgaagcgcagggagtccggatccatatccagctcgcgggccatcgtccctgacagccaggccgtttgctcccgctcaccaagggacatcgacgggcgcggaaatgaccgctgtaatgtgcgactggcgggaaacgccaacataatgtgatgacgctgcggcagttcgcgactccacggtaacaacgttttagccagctgctgcgcatcaacaatccgcccatctttgataatgtcgttctccagcggcaaccgccaccagcgttgcaaaaagcattcttttgcgccccgcacgatcgcaaccgctaccgcttcttgctgttgtaaatgcaaaccaatttgccagatcttaaatgccattgtgatgatctccttatcacccgtcactctgacgggtatatcaatgcgtctggcttgcctttatactaccgcgcgtttgtttataaactgcccaaatgaaactaaatgggaaatttccagtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccaccggagatggtgaaagcctttatcgcgacagaagacagccgcttctacgagcatcacggcgttgacccggtggggatcttccgtgcagcaagcgtggcgctgttctccggtcacgcgtcacaaggggcaagtaccattacccagcagctggcgagaaacttcttcctcagtccagaacgcacgctgatgcgtaagattaaggaagtcttcctcgcgattcgcattgaacagctgctgacgaaagacgagatcctcgagctttatctgaacaagatttaccttggttaccgcgcctatggtgtcggtgctgcggcacaagtctatttcggaaaaacggtcgaccaactgacgctgaacgaaatggcggtgatagccgggctgccgaaagcgccttccaccttcaacccgctctactcgatggatcgtgccgtcgcgcggcgtaacgtcgtgctgtcgcggatgctggatgaagggtatatcacccaacaacagttcgatcagacacgcactgaggcgattaacgctaactatcacgcgccggagattgctttctctgcgccgtacctgagcgaaatggtgcgccaggagatgtataaccgttatggcgaaagtgcctatgaagacggttatcgcatttacaccaccatcacccgcaaagtgcagcaggccgcgcagcaggcggtacgtaataacgtgctggactacgacatgcgccacggctatcgcggcccggcaaatgtgctgtggaaagtgggcgagtcggcgtgggataacaacaagattaccgatacgctgaaggcgctgccaacctatggtccgctgctgcctgccgcagtcaccagcgccaatcctcagcaagcgacggcgatgctggcggacgggtcgaccgtcgcattgagtatggaaggcgttcgctgggcgcgtccttaccgttcggatactcagcaaggaccgacgccgcgtaaagtgaccgatgttctgcaaacgggtcagcaaatctgggttcgtcaggttggcgatgcatggtggctggcacaagtgccggaagtgaactcggcgctggtgtcgatcaatccgcaaaacggtgccgttatggcgctggtcggtggctttgatttcaatcagagcaagtttaaccgcgccacccaggcactgcgtcaggtgggttccaacatcaaaccgttcctctacaccgcggcgatggataaaggtctgacgctggcaagtatgttgaacgatgtgccaatttctcgctgggatgcaagtgccggttctgactggcagccgaagaactcaccaccgcagtatgctggtccaattcgcttacgtcaggggctgggtcagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcgtccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtaccaatgccgcagctggagcaggcaaatcaggcgttagtggcgaagactggcgcgcaggagtacgcaccgcacgtcatcaacactccgctggcattcctgattaagagtgctttgaacaccaatatctttggtgagccaggctggcagggtactggctggcgtgcaggtcgtgatttgcagcgtcgcgatatcggcgggaaaaccgggaccactaacagttcgaaagatgcgtggttctcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggagcagccgctgacgccgccaccgggtattgtgacggtgaatatcgatcgcagcaccgggcagttagctaatggtggcaacagccgcgaagagtatttcatcgaaggtacgcagccgacacaacaggcagtgcacgaggtgggaacgaccattatcgataatggcgaggcacaggaattgttctgattaaaaaggcgcttcggcgccttttcagtttgctgacaaagtgcacttgtttatgccggatacggcgtgaacgcgttatccggctaacaaaatcgtgaaaactcaataaattgcagaaaccccataagcctgataaacattgtgcatcaggcaaacttcacgcatttacactcgcccctgccctttcaaccattcgcgcacgaggaacagcgcactgacattgcgcgcttcattgaagtcagggtcttccagcaaatccatcatatgcgccagcggccagcgcacctgtggtagcggctctggctcatcgccttccagtgattccgggtagagatcttgcgctaccacgatattcattttgctggaaaagtaagacggtgccatgctgagcttcttcaaaaaagtcagatcgttcgctccaaatccaacctcttcttttagctcgcggttagcggcttcgtagacgctttcacccggatcaattaatcctttcgaaaaacctaattcgtaggattcagttcccactgcgtattcgcggatcaggatcaggtgatcgtccacaatcggcacaatcatcactgcttcccggttggttggacgcattcgttcataaacacgccgcacgccattgctgaactccagatccacgctctcgacggtaaacagtcgggaacgggctacagtttcaacattcagaatggtgggtttttgtaatgatttgctcatcgtgggatctatgctgtgaaatcagcggttattgtgcgatatcggacacgctttcggcaatgtgaattgcatgttatttacatttatgtaacttaataaataatcgtcctcaaatcaaattaaaagtcaataggttgaaataactccaggaatttgctgatattccgccttcagagggtttgctatgatcagcggttactgtgatgtgcttaatgatgctcaagttaaactccacgcttgccgatagccaaccgcagaatcatgtattgtgtccggtgcgactgaccacgcctgacagactaagtaagatggggaaagcatgagcaccattgtgatttttttagctgctttgctggcctgctcactacttgcgggatggctgataaaagtgcgatccagacggcgtcagctgccctggaccaacgccttcgcggatgcgcaaacgcgtaaactcacacctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttacggcatctctaccgacgatccgaataaatggcgttactacctcgattcggtagaagtccacctgccccctttctgggaacagtacatcaacgatgagaataccgttgaactgattcataccgattcgctgccgctggttatttcactcaacggtcatacgctgcaggagtacatgcaggaaactcgcagctatgccttgcaacctgttccgtcaacgcaggcgtcgattcgcggggaagagagtgagcaaatcgagctactcaatattcgcaaagaaacgcatgaagaatatgcgctgagtcgtccgcgcgggctgcgtgaagcgttgctgatcgtcgcctccttcctgatgttctttttctgcctgattaccccggatgtatttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatctcggtcaacaaaccgatatcgatatctatctcgaccgccatgtagtgcgtcagggacgatatctttcgctgcatgatgaagtaaaaaactttccgttacagcactggctgcgcagtacgattatcgctgcgggctcgctgctggtgctgtttatgctgttattctggatcccgctggatatgccgctgaaattcactctctcatggatgaaaggcgcgcagaccattgaagccaccagcgtaaaacaactggctgacgctggcgtgcgggtaggcgatacattgcgtattagcggtacgggaatgtgtaatattcgaacttccggaacctggagcgcgaaaaccaattcaccttttttaccgtttgactgctcgcagatcatctggaacgacgcccgctcattgccattaccagaatctgaactggtcaacaaagcgacggcattgactgaagcagttaatcgccagctgcaccctaaaccggaagatgaatctcgcgtcagtgcctcattacgttcagcaattcaaaaatccggcatggtattgcttgatgattttggcgacattgtactgaagacagcggatttatgttctgccaaagatgactgtgtgcgactgaaaaatgcgctggtcaatctcggcaacagtaaagactgggacgcgctggtaaaacgcgccaacgccgggaagctcgatggcgtgaatgtgttattacgcccggtgagtgcggaatcgctggataacctggtggcaacctccaccgcgccgtttatcacgcatgaaacggcgcgagcggcacaatcactaaacagtccggcccccggcggattcctgattgtcagcgacgaaggcagcgattttgttgatcagccctggccttcggcatcactttacgactacccgccgcaagaacagtggaacgctttccagaaactggcacaaatgctgatgcatacgccgtttaacgccgagggtatcgtcacaaaaatcttcactgacgccaatggtacgcagcatattggccttcatccgatcccggatcgttccggcctgtggcgctatctcagcaccacattgctgctactgacgatgctgggtagcgccatttacaatggcgtacaggcctggcgtcgttaccagcgtcatcgcactcgcatgatggagattcaggcctattatgaaagctgcctgaacccgcaactgatcaccccttcagaaagccttatcgaataacacgtttgcgcggcaggttatgctaccctgtcgcgcaaattgcttcactctggagatttccctcatgcatatcaacattgcctggcaggacgtagataccgttctgctggatatggacggcacgttgctcgacctcgccttcgataactatttctggcaaaagctggtgcctgaaacatggggcgcgaaaaacggggttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaagcagcgaattttgctcaccaatgcgcatccgcacaacctggcggtaaaacttgagcataccggtctggacgcacaccttgatttattactttccacccacacatttggttatccgaaagaggatcagcggttatggcatgcggtggccgaagctacgggtctgaaagctgaaagaacgctgtttattgatgacagcgaagcgattctcgatgctgccgcgcaatttggtattcgttactgcctcggcgtgactaatcctgattccgggattgccgagaaacagtatcaacgccatccgtcactgaatgactaccgccgcctgatcccctcgctaatgtgaaggagacgccatgaaagagaaacctgctgttgaggttcgactggataaatggctatgggctgcccgtttttataaaacccgcgcgctggcccgtgaaatgattgaaggcggtaaggtgcattacaacgggcagcgcagcaagccgagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcacccggaccgacgcccggacaaaaaagagcgccgcgacctgttacgatttaaacacggcgacagtgaataactgtcacctgcaagagagatgattatgccgcaacatgaccaattacatcgctatctgtttgaaaactttgccgtgcgcggcgaactggtaaccgtttcggaaaccctgcaacagatccttgagaaccacgattatccgcagcccgttaaaaacgtgctggcagaactgctggttgcgaccagcctgttaaccgctacgctgaagtttgatggtgatatcaccgtacagctgcagggcgacggtccgatgaatctggcggttattaacggtaacaataaccagcagatgcgcggtgtggcgcgcgtgcagggcgaaattccagaaaatgccgacctgaaaacgctggtcggcaatggttacgtggtgatcaccattaccccgagcgaaggcgaacgctatcagggcgtagttggtctggaaggtgataccctggcggcctgcctggaagattactttatgcgttctgaacagctgccgacgcgcctgtttattcgcaccggcgacgtagacggcaaaccggctgcaggcggtatgttgttgcaggtaatgcctgcgcaaaatgcccagcaggacgactttgaccacctggcgacgctaaccgaaaccatcaaaaccgaagaactgctgaccttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagttgatagcatcctggcggaagatggcgaaattgacatgcattgtgattactgcggtaaccactatctgttcaatgcgatggatattgctgaaatccgcaacaacgcgtctccggcagatccgcaagttcattaatgagtatgtccggcagagagggctctgccggattttacgactaatacacctgatgcgctttgtcactcattcagattcacattcagcctttcaccatccactacaagatcgcgccacgctttaggcttcgtccccagttttccatccttcgcagctgtgagtaatttttctttcgttatttcgttcggaagtaaactcatatcaagcgcgtcccattcttttctgtctgagtcaaagccatagacaatgactctgtcatcattaaaagcaaacaggatccgctccgcctgaccatcactattcagatcttgctcgaccaggacgcaggcgtctttttcaatacaggtcatcacgttatagcgatcctggattaaggccgaccagaatgtcgcatcaggtttaacagaaccaggggcaattaacacattatcggctaatactttttccgatacctgttgctgaagatgttgctctccatctaacgccatcagcagatcccgcgcgcgtttcgggtctttcataaacccggcatcgcttttcagcgactcaagcgcagcacgtccatagcgaccgctctgctcgagcatgtagatagttacctggtctgacgtgtttttgccgctctgataacgcgccatatggctgttcacgctaatgcgcatactgtccagcaccggcgaattaagaagcaccagtatcaccaacaccaataacgaaaccgcaaggttcactttgccctgaagaacaacgggattttgccctttacgccagacgatgctgacaaaataccccagcgaccacaccagtaacaccagcaccgccagcacgccctgcaagcggtcgacagtccagccgtactgagcgacccgcagccataacgcccaggcggcgacgaacacatacagcggagcaaccagcaaagcggttttaatcaggcaacgcaacggccctgtccagggaagtgacgctttttgcggatcgcggacaatagccattaagatcaattgcaaaaaggccagcgtcaacagcaacccggcggcggagatgtggcgagaaatcgcgctcaggcccgtaaacggcagggtgatgataaacatcagggttagcaatgatactaacggcagcaaccccgtggcgattaacgtgaacaacttttgaatagagtcgattaaacgtgactgtgttcgcgcgaggatcaccgccagcgcggtaaccagacctaacgtgagataaataaaccagtcggttgcaaaaaagagcgtattgaaaaacgtgatgccaacaagtttaaacaactcactccacagtaaaagcaccagccacgtcaagccattggcgagaaaaatcaccagtaatataagtacgttatgccatactgactggtaaaaatagcgatagcggctactgtcattgcggatgcgaaggctttgttgtatccacggtagcaacaacattgccatcaacagcagatagcaaccaaaatcccaaagcgccttttcagctctccaggggttcatgccatcagtttgccacttcagccagccgctcatccccagcgtggcaataaacactagcgccagccatccccaaaggcgcttctgtttaaaagagatcacggagaagagtaaaacggatgaaaacgcgacggtcgcaggcacgccataaacaatccaactgtgattttttccggaaagccaggcgatcagcaggtagcaaaccagaccctgaagtaatccggtagcaatcatcccccagcgtgttgcgggtgaaagttcaacgttatccatgttggttatccagaatcaaaaggtgggttaattatcgcatccgggcagtagtattttgcttttttcagaaaataatcaaaaaaagttagcgtggtgaatcgatactttaccggttgaatttgcatcaatttcattcaggaatgcgattccactcacaatattcccgccatataaaccaagatttaaccttttgagaacattttccacacctaaaatgctatttctgcgataatagcaaccgtttcgtgacaggaatcacggagttttttgtcaaatatgaatttctccagatacgtaaatctatgagccttgtcgcggttaacacccccaaaaagactttactattcaggcaatacatattggctaaggagcagtgaaatgcgcgttaacaatggtttgaccccgcaagaactcgaggcttatggtatcagtgacgtacatgatatcgtttacaacccaagctacgacctgctgtatcaggaagagctcgatccgagcctgacaggttatgagcgcggggtgttaactaatctgggtgccgttgccgtcgataccgggatcttcaccggtcgttcaccaaaagataagtatatcgtccgtgacgataccactcgcgatactttctggtgggcagacaaaggcaaaggtaagaacgacaacaaacctctctctccggaaacctggcagcatctgaaaggcctggtgaccaggcagctttccggcaaacgtctgttcgttgtcgacgctttctgtggtgcgaacccggatactcgtctttccgtccgtttcatcaccgaagtggcctggcaggcgcattttgtcaaaaacatgtttattcgcccgagcgatgaagaactggcaggtttcaaaccagactttatcgttatgaacggcgcgaagtgcactaacccgcagtggaaagaacagggtctcaactccgaaaacttcgtggcgtttaacctgaccgagcgcatgcagctgattggcggcacctggtacggcggcgaaatgaagaaagggatgttctcgatgatgaactacctgctgccgctgaaaggtatcgcttctatgcactgctccgccaacgttggtgagaaaggcgatgttgcggtgttcttcggcctttccggcaccggtaaaaccaccctttccaccgacccgaaacgtcgcctgattggcgatgacgaacacggctgggacgatgacggcgtgtttaacttcgaaggcggctgctacgcaaaaactatcaagctgtcgaaagaagcggaacctgaaatctacaacgctatccgtcgtgatgcgttgctggaaaacgtcaccgtgcgtgaagatggcactatcgactttgatgatggttcaaaaaccgagaacacccgcgtttcttatccgatctatcacatcgataacattgttaagccggtttccaaagcgggccacgcgactaaggttatcttcctgactgctgatgctttcggcgtgttgccgccggtttctcgcctgactgccgatcaaacccagtatcacttcctctctggcttcaccgccaaactggccggtactgagcgtggcatcaccgaaccgacgccaaccttctccgcttgcttcggcgcggcattcctgtcgctgcacccgactcagtacgcagaagtgctggtgaaacgtatgcaggcggcgggcgcgcaggcttatctggttaacactggctggaacggcactggcaaacgtatctcgattaaagatacccgcgccattatcgacgccatcctcaacggttcgctggataatgcagaaaccttcactctgccgatgtttaacctggcgatcccaaccgaactgccgggcgtagacacgaagattctcgatccgcgtaacacctacgcttctccggaacagtggcaggaaaaagccgaaaccctggcgaaactgtttatcgacaacttcgataaatacaccgacacccctgcgggtgccgcgctggtagcggctggtccgaaactgtaatgatttgaagctggagaatatctatccagtatcttatagaaagcaaaacgggaggcaccttcgcctcccgtttatttacccttcttttgtcgtgccctgcgcccgcgttaccggcactggcagccaggcgcgaatggaaagcccgccccgctcgctggtgccaagctccagcatcccgttatggttatccacgatacgctgcacaattgccagccctaatcccgtgccgctaatggtgcgcgcactgtcgccgcggacaaacggctggaacaggtgcttacgttgttccggcgcaattcccggaccgtcatcttccacctggaaccaggcgcgattcggctccgttccgctgctgactttgatccagccattgccataacgggcggcgttgaccaccatattcgccaccgcgcgtttgatcgacagcgggtgcattttcacttcaatgctgccggggtaaagcgcggtttcaatttcccgctcatagccactttcggcagcaatcacctcaccgagtactgcattaagatccgccatttccatcggcatctcctgcccggtgcgcaggtagtcgataaactgctcaatgatggcgttgcactcttcgatatctttattgatcgattctgccagatagccatcctgctcgctcatcatctcagtcgccaggcgaatacgcgtcagcggcgtgcgcaagtcgtgacttacccccgccatcagcagcgtgcggtcatccgccagttgcttaacaccagccgccatatggttaaaggcacgggtaacggaacgcacctccgaagcgccatactcacgcagcggcggcggaataatccctttaccaacctgcaaggctgcgtgttcgagatcgaccaacggtcggttctggatacgaataaacagccacgccccgcctatcgccaatagcataatcgccagcgtatagcggaacagcggagagaaatcgccctgatgaatttcggtcagcggcacgcgtacccagatattgggcgacagccaggttttcagccagacgacaggcgaacttttgttgacctcaacgcgcacttccgtcgggccgcccagttgctgcgccatctgatggcttaagaattcatagtgttgcgcccaacgcagacctgcctcttcggcagcctcgttggagtagagagagatccccagctcacggtagatctcccgacggaaagcgggaggcacaaccaactgcgtgccgtcctccagttgcagtttgtcggtcatcaacatacgcacttcgtacgcgaggactttattaaactgctggaggctcggcaaaatcgcgaagttcagcaccaccagataagtcgtcaccaggctggcgaacagcaaggtgacgatgagcaataacgtacgggcaaatgaacttcgtggcgagaagcgcaatcgcctcatgctttagagccgtccggtacaaagacgtagcccagaccccagacggtctgaatgtaacgcggatgcgctggatcttcttccaccatgcggcgcagacgcgaaatctgcacgtcgatggagcgttccattgcggaatattcacgaccacgggcaaggttcatcagcttatcgcgggagagcggctcacgcggatggctgaccagtgccttcagtaccgcaaactcaccgctggtgagcggcatcggctcgtcttcgcggaacatttcgcgcgtaccgaggttaagtttgaacttaccgaaagcaattaccgcctcttcctgtgacggtgcgcctggcagttcgttcgcctgacgacgcagcaccgcacggatacgggccagcagttcacgcgggttaaacggttttggaatgtagtcgtcagcgccaatctccaggcctacgatacggtccacttcttcccctttcgccgtcaccataatgatcggcatcgggttgctctgactacgaagacgtcggcaaatcgacaagccatcttcaccaggtaacattaaatccagtaccataagatggaaagattcacgagtcagcaggcgatccatctgttctgcattagcgacgcttcgaacctggaagccttgttcggtgagataacgttccagcagcgcacgcaggcgcatgtcgtcatcgaccaccagaatcttgtagttctcttgcattgtttgtactcccaaaggttcgcaacaatttgtaagcgtgtattcttaaaaaagctcacgttcgtcaccagctaaatctggtatgaatttcagcctaaattgttacaaagcatattaaacagcagcttaagtatacaatttattcggcgaaacattattgattctgttgatatgatcacgttatacccaatgtgcgcattatcaaacagacaaagggaatcaacgagatgaaaacgcccctggttacccgggaagggtatgaaaaactcaaacaagagcttaattatctctggcgtgaagaacgcccggaggtcacaaaaaaggtgacctgggccgcaagtctgggcgaccgcagcgaaaatgctgactatcagtataataaaaagcgtctgcgtgaaatcgaccgtcgcgtgcgctatctcactaaatgcctggaaaatctcaaaatcgtcgattactcccctcagcaggaaggcaaagtcttttttggcgcgtgggtggagattgaaaacgacgatggcgtgactcaccgtttccgtattgtcggctacgatgaaatttttggccgtaaagattacatctctatcgattccccgatggcccgcgcattgctgaaaaaagaagtcggcgatctggcggtggtgaatacccctgccggggaagcgagctggtatgttaatgctatcgagtacgtgaaaccgtaaggaagagtcttaacctcctgccgatggctggcatttttgccagccagtccgtataactatcccctgatttttgatccgaaaagatgaactcaaaccatgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaagtccatttccgagcaaggcaaactcaccgatgatctggcgaaggccatcaacgccaccctaagcaaaaccgaactcgaagacctctacctgccctacaaacctaaacgccgcacccgcgggcaaatcgccattgaagcagggcttgagccgttggctgacctgctgtggagcgatccgtcacacacgccagaagtcgccgctgcacaatatgtttatgccgataaaggcgtggcagataccaaagccgcgctggatggcgcgcgctatatcctgatggaacggtttgccgaagatgccgcgctgctggcgaaagtgcgtgattatctgtggaagaacgcgcatttggtttctacggtggtgagcggtaaagaagaggaaggggcgaaattccgcgactatttcgatcatcacgaaccgttgtccacggtgccttctcaccgcgcgctggcgatgttccgtgggcgtaacgaaggcgtacttcagctttcgctgaatgccgatccacagttcgatgagccgcccaaagagagctattgcgagcaaatcatcatggatcaccttggcctgcgcctgaacaatgccccggcggatagctggcgcaaaggcgtggtgagctggacgtggcgcatcaaggtgctgatgcatctggaaaccgaactgatgggcaccgtgcgcgaacgtgcggaagatgaagcaatcaacgtctttgcccgtaacctgcacgatctgctgatggcggcccctgccggactgcgtgcaacgatgggcctcgatccgggtctgcgtactggggtaaaagtggcggtggtcgatgccactggcaaactggtggcgaccgacaccatttacccgcacaccggacaggccgcaaaagcagcgatgaccgttgctgcgctgtgtgaaaaacataacgttgaactggtagcgatcggtaacggtacagcttcccgcgaaactgagcgtttctatctcgatgtgcagaagcagttcccgaaagtgaccgcgcagaaagtaatcgtcagcgaagcaggcgcgtcggtttactcggcttccgagctggctgcacaggagttcccggatctcgacgtttcgctgcgtggcgcggtgtctatcgcccgccgtttgcaggatccgctggcggagctggtgaaaatcgatccgaaatctatcggcgtaggtcagtatcagcatgacgtcagccagacgcaactggcccgcaaactggacgcagtagtagaagactgcgtaaacgccgttggcgtcgatctcaacactgcttctgttccgctgttaacccgcgtggcgggcctgacgcgcatgatggcgcaaaacatcgttgcctggcgcgatgagaacggtcagttccagaaccgtcagcaactgttaaaagtgagccgtctggggccgaaagccttcgagcagtgcgcgggcttcttgcgcattaaccacggtgataacccgctggacgcgtctaccgttcacccggaagcctatccggtggtggaacgcattctggcagcaacacagcaggcactgaaagatctgatgggtaacagcagcgaactgcgtaacctgaaagcgtctgactttactgatgagaaattcggtgtgccgacggtaaccgacatcatcaaagagctggaaaaaccgggtcgcgatccgcgtccggaatttaaaaccgctcagtttgccgatggcgtcgagacaatgaacgacctgcaaccgggtatgatcctcgaaggcgcagtgaccaacgtcaccaactttggcgcgtttgtcgatattggcgtgcatcaggacggcctggttcacatctcttcattgtcgaacaagtttgtggaagatccgcataccgtggtgaaagcgggcgacattgtgaaggtgaaagtgctggaagtggatcttcagcgtaaacgtatcgccctgactatgcgcctggatgagcagcctggcgaaaccaacgctcgtcgcggcggcggtaatgaacgcccgcaaaacaaccgcccggcagccaaaccacgcggtcgtgaagcgcagcctgccggtaatagcgcgatgatggatgcgctggcggcggcaatgggcaaaaaacgttaaacgcccgtactggcctacggttcgaatttgcacgaaatcgtagggcagataaggcgttcacgccgcatctggcaacgaacgccttgcctgacataaaagtgccggagaatatctccggcatttttattccacagccaaactcataatatattccggcaatatttatcatttcattaacaactgaaaccttaattaaacattagccagtccgggtaattcactattcgaattatattttcgctgcgatataaccttgagccacatcaacattgagtcagattattattcaaaccaacattcgcacacattttaagtattgctgatagaaaccattctcattatcattgtgttgttgattatttaatctctcctttgttggcaaatcatctggtctcatgtcgctgtcaaacgccccatgaggtagttatccagttaatgagaaacaagtaggcacctatgcaatacactccagatactgcgtggaaaatcactggcttttcccgtgaaatcagcccggcatatcgccaaaaactgctttctcttggcatgttacctggctcctcttttaatgtggtgcgcgtcgctccactcggcgaccccattcatatcgaaacccgtcgtgtgagcctggtattacgcaaaaaagatctggccttattagaagtggaagcggtttcctgttaatacggtgataacaacaatgaaaaaattaaccattggcttaattggtaatccaaattctggcaagacaacgttatttaaccagctcactggctcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacattttgagtggcgacgccgacctgctgattaacgtggtggatgcgtctaaccttgagcgtaacctgtacctgacgctacaactgctggaactcggcattccctgcattgtggcactgaacatgctcgacattgccgagaagcaaaatattcgtattgaaattgatgctctgtcggcgcgtctgggctgtccggtgatcccgctggtttcaacccgtggtcgcggtattgaagcgctcaagctggcgattgatcgctataaagctaacgagaatgtggaactggtgcattacgcacagccgctgctcaacgaagcagattcactggcaaaagtgatgccttccgacatcccgctgaaacaacgtcgctggctgggcctgcaaatgctggaaggcgatatctacagccgcgcctacgccggtgaagcgtcgcagcatctggatgccgccctcgcccgtctgcgtaatgagatggacgatccggcgctgcacattgccgatgcgcgttaccagtgcattgctgccatctgtgatgtggtaagcaacaccctgacggcagaacccagccgtttcaccactgcggtagataaaatcgtgctcaaccgtttcctcggtctgccgattttcctctttgtgatgtacctgatgttcctgctggctatcaacatcggcggggcgttacagccgctgtttgacgtcggctccgtggcgctatttgtgcatggtattcaatggattggctacacgctccacttcccggactggctgactatcttcctcgcccagggcctgggtggcggcattaacaccgtgctgccactggtgccgcagattggcatgatgtacctgttcctctccttccttgaggactccgggtatatggcgcgtgcggcgtttgtgatggaccgtctgatgcaggcgctgggcttgccggggaaatcctttgtgccgctgatcgtcggtttcggttgtaacgtaccgtcggtaatgggtgcacgtacgcttgatgcaccgcgtgaacgtctgatgaccatcatgatggcaccgtttatgtcctgcggcgcgcgtctggctatcttcgcagtattcgcggctgccttcttcgggcagaacggtgcgctggcggtcttctcgctgtatatgctgggtattgtgatggcggtgctgactggcctgatgctcaagtacaccatcatgcgcggtgaagcgacgccgtttgtcatggagttgccggtctatcatgtaccacacgttaaaagcctgattatccagacctggcagcgtctgaaaggcttcgttctgcgtgctggtaaagtgatcatcatcgtcagcattttcctgagcgctttcaacagcttctcgctgagcgggaaaatcgtcgataacatcaacgactcggcgctggcgtccgtcagccgggtgatcaccccggtcttcaagccaattggcgtgcatgaagataactggcaggcaacggttggcctgtttacaggtgccatggcgaaagaagtggtagtgggtacgctcaacaccctctacaccgcagaaaatattcaggacgaagagttcaatccggcagaatttaacctcggtgaagagctgttcagtgcgatagatgaaacctggcagagcctgaaagacaccttcagccttagcgtactgatgaaccccattgaagccagcaaaggcgacggcgaaatgggtaccggggcgatgggcgtgatggatcagaaattcggtagcgcagcagcagcttacagctacctgattttcgtcctgctgtatgtaccatgtatctcggtgatgggggctatcgcccgtgaatcaagccgtggctggatgggcttctccatcctgtgggggctgaatatcgcttactcactggcaacattgttctatcaggtcgccagctacagtcagcatccaacttacagcctggtgtgcattctggcggttatcctgtttaacatcgtggttatcggtctgctgcgccgcgcgcgtagccgggtggatatcgaactgctggcaacccgcaagtcggtaagcagttgctgcgcagccagcaccaccggtgattgccattaatggcttcacttattcaggtgcgcgatttgctggcgttacggggccgtatggaagcggcccagataagccagacattgaacactccacagccaatgattaacgccatgctgcaacaactggaaagtatgggcaaagccgtgcggattcaggaagaacctgacggctgcctctctggcagttgtaaaagctgcccggaaggaaaagcctgtctgcgcgagtggtgggcgctgcgttaaccttactccatcgcctgttttggaaagcccggtatgcgtctgcatccgggcttttttgcgtgcggctttccataaaaatgcaactcttgcagcacggcgtaagttcctttgaaagcatctcgcagggatgaaaactcgctaatacacaggtgtggagtggcgcgtagagtcgcggcattcaaacaacaggtgaaggaacgccatgagcaaaaagcagagttccaccccacacgatgcgctgttcaaactctttttacgccaaccggacacggctcgtgattttcttgcgtttcatttaccggcacccattcacgcgctttgtgatatgaaaaccctcaagctggagtcgagcagctttattgatgacgatctgcgtgaaagctattccgatgtgctgtggtcggtgaaaacggaacaaggaccaggatacatctattgtctgattgaacatcaaagcacctcaaacaaactgatcgcatttcgcatgatgcgttacgctattgccgcaatgcaaaatcaccttgatgctggatacaaaacgttgccgatggtggtgccattgttgttttaccacggtattgaaagcccctatccctattcgctgtgttggctggattgtttcgccgatcccaaactggcaaggcagctttatgcctccgcatttccgctgattgatgtcaccgtcatgcctgatgatgaaatcatgcagcaccgacgtatggcgctgctggagttaattcaaaaacatattcgtcaacgcgacctgatggggctggtagagcaaatggcctgcttattaagtagtggatacgctaatgacagacaaatcaaagggctgtttaattacatactgcaaactggcgacgctgtacgttttaacgattttatcgacggcgttgccgaacgttcaccgaaacacaaggagagtttaatgactattgcggaaagattgcggcaggagggggaacaatccaaagccctgcatatagccaaaataatgcttgaatccggagttcctcttgcagacatcatgcgctttaccgggctgtcagaagaagagttggctgcggcgagtcagtaaagttctgtctcgccatttcaaaagccacctacaccctctgcttcaacgccaccagcaggtgacaaaactcggccggatgcgaaataaatggcgcatgggccgctttggcgaagatatatgattcgctgtgaggccaaagtttatccagcatcggcaccactttgcgcggcaccagaccgtcgagatagccatacaatcgcaaaaacggcatggacacgttttgcagcggctgacggagatcgaccgttttcaggatttccagcccgccattaagcacgtcaacctccggcatcggtaacgccagaacggttttcttcaacgcccgcgcatcctggcgcgccgtttcagtccccatggtttgtaacgccaggaaccgctccactgtacgctgaaaatcatcactgagttgctgctgaaatcccgccagcacgtccggttttatccccggccactcgtcacgagcactaaaacaaggtgacgacgccacggtgaccagcgcctgaacacgctcgggatgggttaacgcaatctggcttgccaccagcccgcccagactccagcctaaccaaatggctttatcaggtgcctgttgcagcacggcttcggccatatcagcaagtgacagcgcaccaaatccccggctacgcccgaagccgggcaggtcaacaaggtgcagcgtaaaatgcgagctaagttcctcgtcaatgcaacgccacacttcggcattcagtccccatccgtgcagcagcacaagatgaacattcccctgacctttggtctgccaccagatgttattcatccgctattgttctcttttgacttacaaggatgaacatatgctaacagtaccgggattatgctggctatgccgaatgccactggcgttaggtcattgggggatttgttcggtctgttcacgcgccacccgcacagataaaacgttatgcccacaatgtggattacccgccacacactcccatcttccctgcggtcgctgcctgcaaaaaccgccgccctggcaaagactggtcacggttgccgactatgcgccgccgttaagtccgcttatccaccagcttaaattttcccggcgcagtgaaatcgccagcgccctgtcacgtctgttactattggaagtcttacacgctcgtcgcaccaccgggttgcaattgccggatcgcatcgtcagcgttccgttatggcagcggcgtcactggcgtcggggatttaatcagagcgatttgctgtgtcagccgttatcacgctggttgcactgccaatgggatagcgaagccgtcacacgtacacgggccactgcgacccagcattttctcagtgcccggctgcgcaagcgcaacctgaaaaatgcctttcgtcttgaattgcccgtgcaaggtcgccatatggtgattgtggatgatgtcgttaccaccggaagtaccgtcgcagagattgcgcagttgcttttacgcaatggtgcggcggctgtccaggtctggtgcctttgtcgaaccttgtagagcctcgatgatgggcgtattataaccaactaaaatagtcaactattaggccattactatgatccgtatttccgatgctgcacaagcgcactttgccaaactgctggcaaatcaggaagaagggacacaaatccgcgtatttgtgattaaccctggcacgcctaacgctgaatgtggcgtttcttattgtccgccggacgctgtggaagccaccgacacagccctgaaatttgacctgctgaccgcgtatgttgatgagttaagcgcaccatacctggaagatgcagagatcgattttgttaccgaccagttgggttcccagttaacgctgaaagccccgaacgccaaaatgcgtaaagtggcagacgatgcaccgctgatggagcgcgtggagtatatgctgcagtcgcagatcaacccacagcttgctggtcacggtggtcgcgtttcgctgatggaaatcaccgaagacggttacgccattctgcaatttggcggcggctgtaacggttgttccatggtcgatgtgacgctgaaagaagggatcgagaagcagctgctgaacgaattcccggagctgaaaggtgtgcgcgatctcaccgaacaccagcgcggcgaacactcctactactaagttatcccctcttttgtagattgcccgatgcgacgctaaagcgtcatttcgggcctacgttgaacatgtgccagacgttggcgcagcattgctttgtcaaatcctcggttcgtttccccgcgataatatgaccaacctctcataatttaaatttaccccgctctggtgattctcaaacgccagatgttacccgtatcattcacatgggtaccaaacatactcctgacatctgactacaataattagttttagtgggtatcagtcgtggtgccgcaatatctctgttcccgattgggataattagagtttgtcgtcagaaaattgacgttacccataacaaatgaaaggccaggtaaatcatgccattagtcattgttgctatcggtgtaatcttgttgttgctcctgatgatccgcttcaaaatgaacggcttcatcgctctcgtcctcgtggcgcttgctgttggattaatgcaaggaatgccgctggataaagttattggctccatcaaagccggtgtcggcgggacgctcggtagccttgccctgatcatgggttttggcgcaatgctgggcaaaatgctggcagactgcggtggcgcacaacgtatcgccaccacgctgattgccaaatttggtaaaaaacacatccagtgggcggtggtactgaccggttttaccgttggttttgccctgttctatgaagtgggctttgtgctgatgctgccgctggtgtttaccatcgcggcttctgcgaatattccactgctgtatgttggtgtaccaatggcggctgcactgtctgtgacccacggcttcctgccaccgcatccgggtccgactgcgattgccaccattttcaatgccgatatgggtaaaaccctgctgtacggtactattctggcaatcccgaccgtgattctcgccggtccggtttacgctcgcgtgttgaaaggtatcgataagccaattccggaaggtctctacagcgcgaaaaccttcagcgaagaagagatgccgagctttggcgtcagcgtctggacctctctggtgccggtagtactgatggcgatgcgtgcgattgccgaaatgatcctgccgaaaggtcacgctttcctgccggtagcggagttcctcggtgacccggtaatggcaacgctgattgccgtgctgattgcgatgttcacctttggtctaaaccgtggtcgttcaatggatcagattaacgacacgctggtttcttccatcaaaatcattgcgatgatgctgttgatcatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgttgcggcaatcactgcgggtggtatcgcggcaccgctgattgcaacgacgggtgttagcccggagctgatggttattgcggttggttccggtagtgtgattttctctcatgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttgataacactgactgccggatgcggcgtgaccgccttatccggcctacgattcgggatgaattagtaggccggataagacgcgtcaagcatcgcatccggcatcaaccgcactctacttcttcttcgctgcagctctgcgccgtctgtccaaatccttcagcaacttgttcacgccatcatcggcaaacatcgactcaagcgttgcggaaagcttgcgtcgccagtttttatactggtaactggtgccaggaatattcaccggttcggccatatccagccagtcttccggctgtagtcctaacagagcactgttactgtcggcaatgtagcgctgcaaaccacggttcagcgtcggcgtcatcgacatcaacgatgccttatgcccggcacgtttcggcagacaaccatatttatgcagtgcatccagcagcccttgcttcgccagttcgcgatcctgatacagaccgcgcagtaccacttcatccggatacagccccagggttttgcccagcgttagatccccgcactcccagtaaccgcgcagcgttggcaggtcatgtgtcgccgcaaccgccatcgactgctccggatacgctttcggtgcacggaacgtcttctcgtggtcgttttcgaaatagagcactttgtaagagtacacaccgctgctgcgcagcttaccgacaatctctaccggtacggtaccgagatcttcaccaatcaccatacagcgatgacgtttactttcgagtgccagaatcgagagcagatcatccaccggatagtgaacatacgcgccctgatctgccgtctcgccatacggtatccaccacaaacgcagcatcgacatcacatggtcaattcgtaatgcgccgcagttttgcatattggcacgcaacagctcgataaacggttcataggcacgcgcggtgatgatatgcgggtccattggcggtaatccccagttctgccccaacgggccgaggatatccggcggcgcgccaaccgatgctttcaggcaatatagttcacggtcacaccaggtttccgccccaccttccgctacgccaaccgccagatcacgatacaagccaatcggcatttcatagccctggcttatctcccagcaggcggcaaactggctgtaagccagccactgcaaccagagataaaaatcgacgtcatcacgatgttcttcgcagaactgacgcacttctggtgaatccacgttctgatacatctctggccatgcaggccagccccagcgcatttcgtcctctttcacttgctgggcatgtagcgcatcaaaggctgcctgccagaacaggctgtcgccctgctctgcaacaaactggcgaaacgcggccatctgctcatcatcacgttgcgcgaaacctttccacgccattcgtaatgctgtcatttttagggcggtaaccgtggagtaatcgacccagtcggcatcgcgcgcctgttgcagcgtctgttgcgtggtcggcaactgccaccaggcctgagcctcttcgctaagatggaaatcttcaacggcgttaacgtcgatataaatcacattcagccaacggcgagaagacgggctgtatgggctggcgctctccggatttgccggatagagcgcatgaatcgggttcaggccaatgaacgacccgccacgttttgccacatccaccagcatcgctttgagatcgccaaaatccccaataccccagtttttttccgatcgcagcgtataaagctgaacgcaggcaccccacagcttttgtttattcagcaacgcctgcggttcgtaacagcgtttcggggcgacaatcacccggcaatgcgcgcgctggtcgtcctgggtgagtgtcagcgtgtgataaccttccggcagcttcgtcggtagattgaacgctttgccccccgttacatggcctttgtactgcgttccttcttcggtggtcagcagccagctatattcgccgctgccctccaccaccatcggcatttttttgccgctggtataaaccatgacattcgggactggcgttaccgccactttcgtggcggtacgttgatgcatcgcgtcaagcaaacgccgtttggtttcggcgctaatcgactgcggtttaccgtgggcattgatgtaattggggctaatccccgccgccagcgcggcattatccagacgtttgctttccatcgagcttccttagcgttttgcctgccagatacgagcctgataatcgcgaatagagcgatccgagctaaacataccgcagcgggcggtattgaggatcgccgcgcgagtccaggcctcctggtcgcggtacagcacatccacctgcttttgtgcctctacataggctgcgaaatccgccatcaccagatacggatcgccgccctgtttgccgatactgtgcagcatctggtcgaaggcatgcttatcgccgtcgctgtatttaccgctttccagctctttcaatactgcgtccagcaccttatctttcttccgccatttcaccgggtcgtagcctttggccagaattgccttcacttgttccacggtatgaccaaaaataaagatattttcttcaccgactttctcggcgatttcaacgttcgccccatccagcgtaccgacagtaagcgcaccattgagcgccagtttcatattgccggtaccggaagcttctttacctgcagtcgaaatttgttcggagatatccgccgccgggatcagtttttccgccgccgaaacgcaataatccggcaggaacaccaccttcaacttatcgccaaccagcggatcgttgttgatcacgtcagccactttgttgatcgcaaagataatattcttcgccaggtagtagcccggtgccgctttcgcgccgaagaggaagacgcgcggtacgcgatcagcctgcgggttttcacgaatttctttgtacaacgccagaatatgcagcagattcaggtgctggcgtttgtactcatgcaaacgtttgatctgaatatcgaaaatcgcctgtggattgatctcaataccggtacgaactttcacaaactccgccagacggactttattcgcctgcttgatctcgcgatattgctgacggaatttcgcatcatcagcgaatttttccagattgatcagctgatcgagatcgttagcccactctttttgcagtgatttatccaacagagccgccagtgccgggttgcactgtttgatccagcgacgtggggtaataccgttggtgacgttatggaatttgttcggccatagctggtgatattccgggaacagatctttcaccaccagatccgagtgcagcgccgcaacaccgttcaccgcgaaaccgccaaccacacacaggttcgccatatgcacttgtttgtcgtgcaccaccgccagtttggcccacactttttcatcgcccggccaggttttctctaccagcgttttaaagcgagtattaatttcgttaataatctgcatgtggcgcggcagtaagcctttcaccagtttcacatcccagcgttccagcgcttctggcatcagggtatggttggtgtaagcgaaagttttgctggtaatggcccaggcgtcatcccagctcatctggtgctcatcgatcagcacgcgcagcagttctggaatcgcgatagttgggtgggtatcgttcagctgaataacttcgtaatccgccagttcgtgcagtttacgccccgccagatgatggcgacgcaaaatatccgctaccgaacaggcacactggaagtattgctgcatcaggcgcagctttttaccggcagtatggttgtcgtttggatagagaactttggtcagtttttccgcattgatgccctgctgttcggcacgcaagaaatcaccgtcgttaaatttagtcagatcaaacggatgcgcgtgcgtcgcctgccacagacgcagcggctgcgccacgccattacgatagccgacaacggggagatcccacgcttgaccggtaatggtaaactccggctcccagcgtccgtctttcgtcactttaccgccaatccctacctgcacatccagtgcttcgttgtggcggaaccacgggtagttactgcgatgccagtcatccggcgcttcaacctgtttgccatcgacaaaagactggcggaacaaaccatattgatagttcagaccgtaacccgtcgcagactgaccgacagttgccattgagtcgaggaagcacgccgccagacgtcccagaccaccgttacccagcgccgggtcgatctcttcttccagcaggtccgtcagattgatgtcataagccttcaacgaatcctgtacatcctgataccagccgagattcaacaggttgttgcccgtcaggcgaccaatcaaaaactccattgagatgtagttaacatgtcgctgattcgccaccggcttggcgaatggctgagcacgcagcatttcggccagtgcttcactcactgctagccaccactggcgaggagtcatttcagccgcagaatttaagccataacgctgccactgacgtgaaagcgcttcctgaaattgcttatcgttaaaaataggttgtgacataggagttccacttttcttagattttcaacacaacgttatcgctagtttgccaggctcgatgttgaccttcctcatcctgcgggggattaggcagggaggagttgcggggatgagcaaggaaatgtgatctcaaccacttaaagctagtgcaaaccacaggattagcatcaaatcaatgcaatacagcgcagaaaatctgtatctaagtgcaaaaaatggccgttgcgtattttcaaaaagcggaaggtaactctataaattaagtaaaggagtgaaacagtttcataagtaaaatatccagtgtgctccatctcattcttaatagatttattaagatcatctttttagatggcactttcatcaggaatgaagaagaaacccttgcttaaatgaatctgatgaacataagggaaaccagtattcacgctggatcagcgtcgttttaggtgagttgttaataaagatttggaattgtgacacagtgcaaattcagacacataaaaaaacgtcatcgcttgcattagaaaggtttctggccgaccttataaccattaattacgaagcgcaaaaaaaataatatttcctcattttccacagtgaagtgattaactatgctgattccgtcaaaactaagtcgtccggttcgactcgaccataccgtggttcgtgagcgcctgctggctaaactttccggcgcgaacaacttccggctggcgctgatcacgagtcctgcgggctacggaaagaccaccctcatttcccagtgggcggcaggcaaaaacgatatcggctggtactcgctggatgaaggtgataaccagcaagagcgtttcgccagctatctcattgccgccgtgcagcaggcaaccaacggtcactgtgcgatatgtgagacgatggcgcaaaaacggcaatatgccagcctgacgtcactcttcgcccagcttttcattgagctggcggaatggcatagcccactttatctggtcatcgatgactatcatctgatcactaatccagtgatccacgagtcaatgcgcttctttattcgccatcaaccagaaaatctcaccctggtggtgttgtcacgcaaccttccgcaactgggcattgccaatctgcgtgttcgtgatcaactgctggaaattggcagtcagcaactggcatttacccatcaggaagcgaagcagttttttgattgccgtctgtcatcgccgattgaagccgcagaaagcagtcggatttgcgatgacgtttccggttgggcgacggcactacagctaatcgccctctccgcccggcagaatacccactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgccctcatcacccgtgtgaccggcgaagaaaacgggcaaatgcgcctcgaagagattgagcgtcaggggctgtttttacagcggatggatgataccggcgagtggttctgctatcacccgctgtttggtaacttcctgcgccagcgctgccagtgggaactggcggcggagctgccggaaatccaccgtgccgccgcagaaagctggatggcccagggatttcccagcgaagcaattcatcatgcgctggcggcaggcgatgcgctgatgctgcgcgatattctgcttaatcacgcctggagtctgttcaaccatagcgaactgtcgctgctggaagagtcgcttaaggccctgccgtgggacagcttgctggaaaatccgcagttggtgttattgcaggcgtggctgatgcaaagccaacatcgctacggcgaagttaacaccctgctagcccgtgctgaacatgaaatcaaggacatcagagaagacaccatgcacgcagaatttaacgctctgcgcgcccaggtggcgattaacgatggtaatccggatgaagcggaacggctggcaaaactggcactggaagagctgccgccgggctggttctatagccgcattgtggcaacctcggtgctgggtgaagtgctgcactgcaaaggcgaattgacccgctcactggcgctaatgcagcaaaccgaacagatggcacgccagcacgatgtctggcactacgctttgtggagtttaatccagcaaagtgaaattctgtttgcccaagggttcctgcaaaccgcgtgggaaacgcaggaaaaagcattccagctgatcaacgagcagcatctggaacagctgccaatgcatgagtttctggtgcgcattcgtgcgcagctgttatgggcctgggcgcggctggatgaagccgaagcgtcggcgcgtagcgggattgaagtcttgtcgtcttatcagccacagcaacagcttcagtgcctggcaatgttgattcaatgctcgctggcccgtggtgatttagataacgcccgtagccagctgaaccgtctggaaaacctgctggggaatggcaaatatcacagcgactggatctctaacgccaacaaagtccgggtgatttactggcaaatgaccggcgataaagccgccgctgccaactggttgcgtcatacggctaaaccagagtttgcgaacaaccacttcctgcaaggtcaatggcgcaacattgcccgtgcacaaatcttgctgggcgagtttgaaccggcagaaattgttctcgaagaactcaatgaaaatgcccggagtctgcggttgatgagcgatctcaaccgtaacctgttgctgcttaatcaactgtactggcaggccggacgtaaaagtgacgcccagcgcgtgttgctggacgcattaaaactggcgaatcgcaccggatttatcagccattttgtcatcgaaggcgaagcgatggcgcaacaactgcgtcagctgattcagcttaatacgctgccggaactggaacagcatcgcgcgcagcgtattctgcgagaaatcaatcaacatcatcggcataaattcgcccatttcgatgagaatttcgttgaacgtctgctaaatcatcctgaagtacctgaactgatccgcaccagcccgctgacgcaacgtgaatggcaggtactggggctgatctactctggttacagcaatgagcaaattgccggagaactggaagtcgcggcaaccaccatcaaaacgcatatccgcaatctgtatcagaaactcggcgtggcccatcgccaggatgcggtacaacacgcccagcaattgctgaagatgatggggtacggcgtgtaagtttagccggataacgcgccagatccggcttacatctctgcatcattcaatgctcacccgcgttacgccatctgtttctatcaaactaaaccgcaccggcaagaaacgctccaccaccgcgatattggtcagcagatggcatgagggatgggcgaccgtaaattcccccgcgcccgccagcgccatcggtagcaccagttggtcagcaagatattcccccaccgccgccgtgcttgccaggtagcgtttcacctctttcaccaactgtgccgcaaccacctcggcactgacgcgcttttcaccgacgacaaaaaagcgttcggtgatattttcactttcgacttcaagcgagacggtattacccggcccctggtcgcgcggcaggttatgaatattctgttcatgcagggaaaaactccccgccagtgtagcgatttcacgctcagcaacatggcgcggcacaccagctaatagaacttctccacgcatctgcacaatgttcccgcgctcgccaagttgcaaggtgttaaacgatgccacgggcgagacttccgttgccaccacaccgcctccggcagggtaaaaaccgtggcgtaacagcgtggtttgctgatgaattcctattttcgccagcagcggctccagcacccggcggataaaatccgcaggcggcgccgacgggttatcggtgccgccgctcacttcaacacgcgaaggtccatcggcaaaccacagcgcgggcagcaccgtttgcagcaccagcgtacaacttccggcgctaccgatagcaaagcggtaatcgccgccgcgcacggtgccgggccggaagagcagacgctgcgaccccagctccgcgccttccacggttgctccgcaaatttccgtcgccgcctttaccgcggtcagatgctggcgcaacagccccggtttcgcccgcccggcacgaatgctggtgatggtaaatggctggccggttatcatcgacaggctcagcgccgagcgcaggatctgcccgccaccttcgccctgtgcgccatccagcgcaatcatccttttcatcatttatccttttacgcacaccacctgacgcagggtatagataacttccaccagatcgctttgtgccgccatcaccgcatcaatatctttatacgccatcgggatttcgtcgatcacttcggcatctttacggcattccacatgcgcggtggcacgaatttgatcttccacgctgaacagttttttcgctttagttcggctcattacccgcccggcaccgtggctgcacgaacagaacgactcttcatttcccagcccacggacgataaagctttttgctcccatcgaaccgggaataattccatattgaccagcacgcgcagacaccgcgcctttacgcgtcacgtagatctcttcaccaaagtgctgttctttttgcacatagttgtggtgacagttgatctcttccatcgccagcgtttgtggctgtctgaccgttttctgcgtaatgctctgcaatgccgttaccacgttttccatcatcgcatcgcggttaaggctggcaaaaagctgcgcccaggccacggctttcaggtaatcatcaaagtattccgtaccttccataaagtacgccagatcacgcgacggcaacgtctcaagcgtttcctgcatctctttttgtgccagatcgataaagtaagtcccgatggcgttaccaattccgcgtgaaccggagtgcagcataatccacacctggtccgactcatcaaggcagatttcaataaagtggttaccggttcccagcgttcccaggtgtttatagttattggtattcaggaaacggggatatttttgcgttaaccactgataaccggcttcaagctcagcccatttagcatcgacgttaacaggtggattttcccaggcacctttatcacgtttacaacggccagtggtacgcccgtgcggcacggccgtttcaatcgcctgacgcagctctgccaggttttcaggcaggtcttccgccgttaacgcggtacgcagcgcgttcattccacagccaatatccacgcccaccgccgccggaataatcgcccctttggtcgggatcacgctaccaatggtggaacctttacccaggtgtacatcaggcattaccgcaatatgtttgaaaataaacggcatcttcgccgtattaataagttgctgacgcgcatcggcctctaccggcacgcctttggtccacatttttaccggggcattttcagtggtcagtaattcgtaattcattttgtttttctcttttcgttgtttgctgtcctgataattgcaaccgtcgtgccagaaaattaaataagcagcttaattttttaattcattgttttaaaaaagattatatctttacgtccgtaaccggagatttcccgcaaagccaatttaccgataatgaaatatcgtcttttataaggatatctaagatgcgtaaaacagtggcttttggctttgtcggtaccgtactggattatgccgggcgcggcagtcagcgctggtcaaaatggcgtccgacactctgtttatgccagcaagaatcgttggtcatcgatcgactggaattgttgcacgacgcccgctcgcgctcgctatttgaaacgcttaaacgcgatatcgccagcgtttcgccagaaacagaagtggtgagcgttgagattgaactgcataacccgtgggatttcgaagaggtctacgcctgcctgcatgatttcgcccgtggttacgagtttcagccagaaaaagaagactatttaattcacatcaccaccggtacccacgtcgcgcagatttgctggtttctgctggcagaagcgcgttacctgcccgcccggctgatacaatcttcacctccgcgcaaaaaagaacagccgcgcggcccaggtgaagtaacgattatcgatctcgatttaagccgttataacgccatcgccagccgctttgccgaggaacgccagcaaacgcttgattttcttaagtccggcattgccacgcgtaacccccacttcaaccgcatgattgagcagatcgaaaaagtggcgatcaaatcccgcgcgccgattctgcttaacggtccaaccggcgcgggcaagtcatttctggcgcgacgcatcttagagttaaaacaggcgcggcatcagtttagcggcgcgtttgtggaagtgaactgcgccaccctgcgcggcgataccgccatgtcgacgctgtttggtcatgtaaaaggcgcgtttaccggggcgcgggaatctcgtgaaggtttattacgcagcgccaacggcggaatgttgtttcttgatgagattggcgaactgggcgcagacgaacaggcaatgctgctgaaagccattgaagagaaaaccttttacccgtttggcagcgatcgccaggtgagcagtgattttcagcttatcgccggaacggtgcgcgatttgcgccagctggttgccgaaggcaaatttcgcgaagatctgtacgcgcggatcaatctctggaccttcaccctgccgggtctacgccagcgccaggaagatattgaaccgaacctggattatgaagtggagcgccacgcctcactcactggcgacagcgtgcgttttaacaccgaagcgcggcgcgcctggttggcttttgcgacctctccccaggcaacatggcgcggtaactttcgcgaactttctgccagcgtcacgcggatggccacctttgccactagcggacgcatcactctggacgtggttgaagatgagataaaccgtctgcgctataactggcaggagagccgcccctccgcgcttacggcgttgctgggcgcagaggcagaaaacatcgatctcttcgaccgtatgcaactggaacacgttatcgctatctgccgccaggcaaagtcgctttccgcagccggacgccagctttttgacgtttcgcgccagggcaaagccagcgtcaatgacgcggatcggctacgcaaatacctggcgcgttttggtctgacgtgggaagccgtgcaggatcagcacagctccagttgaatatggtggtccgtcagcacctgcatcacgcttactggcggcggggcgtcggtgtagacggcatctaccatgctgatgctgcccatattgaccatcgcgttacggccaaatttcgagtgatcgacaaccagcataacgtggcgcgagttctcaataatggcgcgtttggtgcgaacttcgtggtaatcgaactccagcagcgagccgtcgctatcgatgccgcttatccccagaatgccgaaatcaaggcggaactgggagataaaatcgagcgtcgcttcgccaatgatcccgccatcgcggctgcgtaattcgccaccggcgagaatgatgcgaaaatcttcttttaccatcaacgtgttagcaacgttgagattgttggtgacaatgcgcaaattgctgtgattgagcagtgcgtgcgctaccgcttccggcgtggtgccgatatcgataaacagcgtcgagccattggggatttgctccgccactttgcgggcgatgcgctctttttcttcggtctgggtggccttgcgatcgtgccacggcgtgttaaccgaactggaaggcagcgccgcaccgccatgatggcgcaggatcaggttttgctccgccagctcattgaggtcgcggcgaatagtctgcgggctgacggagaaatgctctaccagctcttcggtactgacataaccctgctgtttaaccagttcgataataccgttgtgacgttgtgtttgtttcatttataaatccctggaattattttcgttttcgcgcattgagcgaatcaacaaaagccatcgctaaacccacggctaacccggcgatgtgtgctccgttcgccatcgacatcccaaacaaatcaaaccatccggcgacaatccagatcagcgcaaagataattaacccacgttgcaggtaaatgccactttgcggatcgcgttcgccacgtagccagacgtagcccatcagcgcatacaccacgccagaaagcccgccaaaccacggcccgctgaatttttgctgcacatagccgcttaacagggcgctgataagcgtaatgacaattagcttaccgctaccgaggcgtttttccaccgcaccgccgagataccaccaccagagcaggttaaagaggatatgcatcagcgagaagtgcattaacgcgtgggtgaagtaacgccagaactcaaatttcagtgttggatcgaatggccaggccagccataacatcacttcctgatcgccgagaatttgcatggcaataaacaccaccacgcaggcgatcatcatcacccaggttaccggacctgcgcgttcacgcaaggcggcaaagaaaggataacggcgataatgcaggccactgccggtatggcctgcctgccagctcgccgccagataacgcggatctgccgggttttcgagaaaacgcgccagctccgcccgtacgcgctcggcctgggactcatccgccagccagacatcgctttggttatgttgttgaatcgtgaggataacaccctgcgtcgccatgtaatcaacaaacgcctgcgccacgcgggggttagcaaaagaggtaatcatcaacatcgttgctgtcgcttattccacacaaaaggggacagtataaagcgttacgcgccgtacgccacctctgcgggaaactgacgttgccaggcttcaaagccgccgtcaatgctatagaccacatcgtagccctgttgcagcagatactgcgccgcgcctttgctgctattgccgtgataacacatcaccatcaccggagtgtcaaagtcgttatcacgcataaaagcgcccagcgtgtcgttggttaaatggaaagcctgcaccgcatgtcccattgcgaaactctgtggatcgcgaatatcgaccagcaccgcctctttttcctgcaacttctggtgcgcgtcggcaacgttaatacattcgaactgatccatgcgtctctctttctttacaaacaagtgggcaaatttaccgcacagtttacgtcgaagcggcagataaacgccataatgttatacatatcactctaaaatgttttttcaatgttacctaaagcgcgattctttgctaatatgttcgataacgaacatttatgagctttaacgaaagtgaatgagggcagcatggaaaccaaagatctgattgtgatagggggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgcctggtcagcgaggcgctggctgaacgtgaagtgctgctgaaaatggccccgcatatcgccttcccgatgcgttttcgcctgccacatcgtccgcatctgcgcccggcgtggatgattcgcattggtctgtttatgtacgatcatctgggtaaacgcaccagcttgccgggatcaactggtttgcgttttggcgcaaattcagtgttaaaaccggaaattaagcgcggattcgaatattctgactgttgggtagacgacgcccgtctggtactcgccaacgcccagatggtggtgcgtaaaggcggcgaagtgcttactcggactcgcgccacctctgctcgccgcgaaaacggcctgtggattgtggaagcggaagatatcgataccggcaaaaaatatagctggcaagcgcgcggcttggttaacgccaccggcccgtgggtgaaacagttcttcgacgacgggatgcatctgccttcgccttatggcattcgcctgatcaaaggcagccatattgtggtgccgcgcgtgcatacccagaagcaagcctacattctgcaaaacgaagataaacgtattgtgttcgtgatcccgtggatggacgagttttccatcatcggcactaccgatgtcgagtacaaaggcgatccgaaagcggtgaagattgaagagagtgaaatcaattacctgctgaatgtgtataacacgcactttaaaaagcagttaagccgtgacgatatcgtctggacctactccggtgtgcgtccgctgtgtgatgatgagtccgactcgccgcaggctattacccgtgattacacccttgatattcatgatgaaaatggcaaagcaccgctgctgtcggtattcggcggtaagctgaccacctaccgaaaactggcggaacatgcgctggaaaaactaacgccgtattatcagggtattggcccggcatggacgaaagagagtgtgctaccgggtggcgccattgaaggcgaccgcgacgattatgccgctcgcctgcgccgccgctatccgttcctgactgaatcgctggcgcgtcattacgctcgcacttacggcagcaacagcgagctgctgctcggcaatgcgggaacggtaagcgatctcggggaagatttcggtcatgagttctacgaagcggagctgaaatacctggtggatcacgaatgggtccgccgcgccgacgacgccctgtggcgtcgcacaaaacaaggcatgtggctaaatgcggatcaacaatctcgtgtgagtcagtggctggtggagtatacgcagcagaggttatcgctggcgtcgtaaattaacgtaaggtgatcaggtcagatttcaatctggcctgagactgatgacaaacacaaaactgcctgatgcgctacgcttatcaggcctacgtggtttatgcaatatattgaatttgcatggtcttgtaggccagataagacgttcacgtcgcatccggcatgaacaaagcgcactttgtcaaaaatctaacctactttttaattcagggaattaccgcaaagcccacgccatcatacccaacgtaacaaaactcaggcacgttccccactcgccccgagaaaaatagcattaatgcgcccagcgccagcataaaaattttgagcagaaggtaaattgttggcgtgataaggatattacaaacttcaataataccggcaagtccgacacccagcatggcaataaccaccgccaaaaattgcgccagtatggggatgccgaaaaaagtcattaccagcgaggtcaaaatccattttctgttttgcattattctttccattctttttgaatggtgaaattatactccccgagtccccttgccccttctggacacttttccgaaatgatggcggaaaaaaacgggaccctttggccccgttctatttattggtgaacttacaatctcaccggatcgatatgccagatatgatcggcgtactctttgatagtacggtcagaagagaagtagcccatattggcaatgttcagcatcgcttttgcggtccactcttcctgaagctcgtagagttcatcgactttatcctgacaatcgacatagctgcgataatccgccagtacctggtagtgatcgccgaagttgatcagcgaatcaaccagatcgcgatagcgacccggatcttccggactgaatacaccgctgccgatttgcgtcagcacctgatgcagctcctcatctttctcgtagtattcacgcggtttgtagccctgacgacgcagttcttccacttcttccgctgtgttaccaaaaataaagatattgtcagcaccgacatgatccagcatctcgacattcgcaccgtccaacgtaccgatagtcagcgcaccgttaagcgcaaacttcatgttactggtgccggaagcttccgtccctgccagcgaaatctgttcagacagatctgccgccggaatgatcaactgcgccaggctaacgctgtagttcgggatgaacacgactttcagcttatcgccaatctgcggatcgttgttgatcactttcgctacgtcattgatcaaatgaataatgtgcttcgccatgtaataggccgaagccgccttaccgccaaaaatattcacgcgcggtacccacttcgcatccgggtcggccttgatgcggttatagcgggtaatcacatgcaacacattcatcaattgacgtttgtattcgtgaatacgtttgatttgtacatcgaacaacgcctttggattcaccaccacattcagctgctgggcgatatactctgccagacgctttttgttctccagcttcgcctgatgcacagcgtgattaaccattgggaaatcacagtgttgttgcagctcattaagcaggctaaggtcggtgcgccagttacggcccaggtgttcgtccagcacggctgaaagcgatgggttcgctaccgccagccagcgacgcggcgtcacaccgttggtgacgttggtgaaacgacccgggaagattttcgcaaagtcggcaaacaacgattgcaccatcagattagagtgcagttccgatacaccgttaactttgtggctcacaacaaccgccagccaggccatacgcacacgacgaccgttggattcatcaatgatcgacgcccgtcccagcagatcggtatcgttcggatactgttcctgcaaggttttcaggaaatagtcgttgatttcaaagatgatctgcaggtgacgcggcagaattttacccagcatatcaaccggccaggtttccagcgcctcgctcatcagcgtgtggttagtgtaggagaagacctgacaacacacctcaaacgcgtcgtcccagctaaattggtgctcatcgatcagcagacgcatcatctcaggaatcgacagtaccggatgggtatcattgagatgaatcgcgattttatccgccaggttatcgtaggttttatgcaactgataatggcggcttaaaatgtcctgaatggtcgaggaaaccaggaagtattcctgacgcaggcgcagctcacgcccggagtaggtggagtcatccggatacagtacgcgagatacgttctcggagtggtttttatcttccactgccgcgaagtagtcaccctggttgaatttaccgaggttaatttcgctactggcttgcgcactccacaaacgcagcgtgttggtcgcgtcggtgtcgtaaccagggattatctgatcgtaagcgactcccagaatctcttcggtttcaatccagcgcgtttttttaccttcctgctgaatgcgaccgccaaaacggactttatagcgcgtgttgtggcgtttgaattcccacgggttaccgtattccagccagtagtctggcgactctttctggctaccgttaacgatgttctgcttgaacataccgtagtcatagcggatgccgtaaccgcgccccggcaaccctaacgtcgccagagaatcaaggaagcaagccgccagacgtcccaggccaccgttaccgaggcctgggtcattttcttcatcaatcagctcttcgagatttaaccccatcgcttccagtgcgccctgtacatcttcgtaaattcctagcgacaacatggcgttggagagcgtacggccaatcaaaaactccatcgacaggtagtaaacctgacgagtttcttgcgacaactgggcacggtttgaacgtaaccagcgctccacgagacgatcgcgcacagcaaataacgttgcgttcagccattcatgtttattggcgacgaccgggtcctttccaatcgtaaacatcagcttgtaagcgatagagtgcttaagagcttctacgctaagcgtgggcgatgaatatgtaaacggagcattcatataggcgtttcctgaaaactatttcaagcgatagtaaagctcacggtacgacttcgccgcgacctgccagctaaaatccattgccatagcctgacgttgcacaaaccgccacagtgaaggacgggaccacagtacaaaagcacgtcgaatagcccgtaacagcgaccaggcattactatcttcaaagacaaacccactggcgacgccatctgcaaggttctcaagagaacagtcagaaaccgtatcagcaagcccaccggtgcgccgcactaacggcagcgtaccgtacttcaatccataaagttgcgttaagccgcacggttcaaaacggctgggcaccagaatgacgtccgcgccgcccataatgcgatgcgaaaatgcttcgtgatagccaatctgaacgcccacctgaccggggtattccgctgccgccgcaaggaaaccttcctgcagcaccggatcgcccgcgccgagtagcgccagctgcccgccctgctccagaagacccggtaaggcttccagcaccaggtcgagacctttctggctggtcagacggctcaccactgcaaaaagcggcactttatcgtcaaccttaagccccattgcgatttgtaactggcgcttattttccgctttatcttccaacgtatcgcgggtgtaacgcgaggccaacagtaagtccgtctctggactccagattttctcgtccacgccgttcagtacgccggaaagacgcccttcacggtgacgctgttgcaacagaccttccataccgtaggcaaactgcggttcggtgatctcgcgagcgtaggttggactgaccgccgtaatgtgatcggcatagtacagaccggccttcaggaaagagatttgtccgttgaattccagcccatgaatattaaagaatgaccatggcaattggatgtcattcatgtgatgtgcataaaacatgccttgataggccaggttgtgcacagtaaacaccgacttcgccggacgcccgcgcgccgccagatacgcaggcgcaaggcctgcatgccagtcgtgcgcatgcaccacatcaggacgccagaatgggtcaagcccgctggccatttctgccccaacccaccccagcagcgcaaaacgcaatacgttgtcggtataggcaaataagttggtatcgtgatacgggcttcccggacgatcatagagatgcggcgcgtcaatcaggtaaatgccaaccccgttgtaatgaccgaacaacagcgtgatatgtccggcgaaggtatcacgacgggatactacctgcgcatcggtcacgccacggcgaatatcgggaaatgcaggcaacagtacgcgagcgtcaacgccgtctgcgatttgtgctgcgggtaatgccccaataacatcagccagaccgccggttttaagcagcgggaacatctctgaacatacatgtaaaacctgcattatcgctcctgtttatgccctaacttccgtagcatttcgcgcgttaccagcacgatgccttcttctgaacgatagaaacgacgtgcatcttcctctgcgttttcaccaatcaccatgccttccggaataacacaagcacgatcgatgacgcagcggcgcagacggcacgagcgacctacccatacttccggtaacaatacggcggaatcaatgttgcagaatgaattcacgcgaacgcgcgagaacagaacggactgcaccaccaccgaaccggagatcacacaaccgccggaaaccagtgagttaagggtcatcccgtggctaccggagcgatcctgcacgaatttcgctggcggtaatgattcattgtaggtgcgaattggccaattgcgatcgtacatatccagttccggcaccacagaggccagatcgaggttcgctttccagtaagcttccagcgtacccacatcgcgccagtacggctcggcatccgggtcggattgtacgcaagagagcgggaacgggtgcgcataggccagaccggcttcggtgatcttgggaatcaaatctttgccaaagtcgtggctggagttctcatcgcgatcgtcttcttccagcagttcatacagatagtcggcgtcaaagacgtagatacccatactcgccagagatttgctcggatcgttcggcattgacggcgggttagcaggtttttcaacgaattcgataattttatcgttctcatcaaccgccataacgccaaatgcggaggcttcttcaatcggtactggcatacaagcaacggtgcaacgtgcgcctttttcgacgtgatcgataagcatacgcgagtagtcttgcttgtagatatggtcgcccgccaggatcaccacgtattccgctttataacggcggataatgtcgaggttttgggtgaccgcatctgcggtgccgcgataccagttttcccctttcattctctgctgtgctggcagcagatcgacaaactcgttcatttcttcattgaagaatgaccagccgcgctgaatgtgctgcaccagagtgtgggactggtactgggtgatcacgcccatacgacggatcccggagttgatgcagttagacagcgcaaagtcgataatgcggaacttaccgccgaagtgtacggccggttttgctcgcttattggttaaatccttcaggcgggtaccacgtcctcccgccagtatcagggcaacagatttcaatggcagctggcgcgccaacattaagtgatcgttcttctctaaactaaccatgactaactccttttttatcatctctggaacacacacaatccgtgtgcaggtccctgccagacagccgtaatcactgggttatcctctccagcgaatgggggaatggcgtgccactccccagcaggtaaaacaatctctgttacctcaagcgtggcgttaattgcgatcaaaaagcgatccgagagcagaatttgcagctgtttcggcccgttttgccactcatccgtgcttaaaggttgagcatatcgatttagccaacggacattgccgtcgccttcttcccaccagcgattctccaccaaagcgggaatgcgcttgcgcagatggattaacgcggcggtaaatgcggttaaaccactgcttgcctgcgaccagtccaaccaggttaattggttatcctgacagtaggcattgttattgccatgctggctgtgaccatgttcgtcaccggccagtaacatcggcgtaccctgggagagcaacaacgttgttaacagggcgtgaatgctgtcgcgccgccgttcaaccaggtcaagagaaccgcctaacccttctttaccatgattgttactgtaattgttgttggtcccgtcgcgattttcttctccgtttgcttcattgtgtttatggttgaagcaaacgcagtcgcgaagcgtaaaaccgtcatgcgcggtgacgagattaatcgcggcactcggcagacgaccattacgtttaaaaacatcgctggaggcagcaaaacgcccggcaaacgcccccagaggcaaatcataatgtagccagaaacgacgggcagcatcgcggaaatgatcgttccactcggcaaacagcggcgggaaatttcccacctgataaccaccaggagcgatatcccacggttcagcaattaacttcacctgcgagagcaccgggcagttctggatagcggtaaacaacggcgcatcctgacggaactctggcgtacggcccatgactgccgccagatcaaagcggaaaccatcgacgtggcaggtttctacccaataacgcaggcaggcgctggcataatccaccaccgccggatgactcaaattgagcgtgttgccgcaaccggtccagttgtgataatcgccgtcttctcttatccaataatagctacggttatcgatcccacgcagcgagaataacgggccgtcgaggtccagttccgcactatggttgagcacgatatcaagaatgacttcgatacccgctttatgcagtgctttgattgcatcgcgaaactcatccagcgccgtttctggcgagcaggcatacgccggatgcagcgcaaacatcgccaccgggttgtaaccccagtagttacttagccccatgcgttgcagacgtggttcactggcaaactgcgccactggcagcagttccagcgcggtaatgcccaattgtttcaaatagttgatcatcaccggatgcccgagggctttataagtgccacggatctcgaccgggatctccgggtgcaagtacgttaatcctttgacatgggcttcataaatgatggtgctgccccacggcgtgcgcggcggggcatcatcttcccagtcatagtgatcaaccaccactacgcatttcggcgcaatggcggcgttgtcgcgatagtcaggttcattatgaccggcgtgcagcagcgggttatctttaaactccccgtcaatttgccgcgcgcaaggatcaatcaacaacttcgccgggttaaagcgatgcccctcggcgggttgccaggggccatgaacgcgataaccataacgcaaacccgggcgcgcatccggcagataaccgtgccaaatgtcgccactgtgccctggcaagtcatagcgatgttcctggccattggcgtcaaagacacacagttctacccgctcggcatgagcggagaaaagtgtgaagttgacgccctgaccgtcgtaatgcgcgccgaggggagcgggtttgccaatggcgagttgtgtcattctgcctcccgaaccagccagatagtggccagcggtggtagcgtcaggcttagtgaatgctgacgaccgtggctggcaatctcatcgctgtgtaccgtgccgccattgcctgcattactgccgtgatagtgcatggaatcggtattgaggatttcacgccatttgcccggctggtttatgccgaagcgataatcatgacgcggtaccggcgtaaagttactggcaacgatgatttcgttaccctctttatcgcgacgcacaaagatcagcaccgagcgttctttgtcatccaccaccagccattcaaagccgtacgggtcaaaatccagttcatgcattgctttatggtggcggtaggtgaggttcagatcgcgcaccagacgctggacaccgtggtgccagttatcgccgccttccaacagatgccagtcgaggctggcgtcatggttccactcgcggccctgggcaaattcgttacccatgaacagtagtttcttgcccgggaatgcccacatccagccatagtaggcgcgcaggttcgcgaatttctgccatgcgtcgcccggcatgcggtcgagaatcgattttttaccgtggaccacttcatcatgcgacaacggcaggacgaagttttcagtgtagttgtagagaatcccgaaggtcagtttatcgtgatgatactgacgataaaccgggtcgagcttcatgtagtccagggtgtcatgcatccagccgaggttccacttgtaccagaagcccagaccgcccatatcctgcggacgagaaacgccagggaaatcggtagactcctcagccattgtcaccgcaccggaaacctgctcaccaagaatacggttggtattacgcaagaattcaatcgcttcaagattctcgcgcccgccaaattcgttcgggatccactccccctctttacggctgtagtcgcgataaatcattgacgccaccgcatcgacgcgcagcgcatcaataccaaaacgttcaatccagtaaagcgcgttaccgacgaggaagttactgacttcacggcgaccatagttgtagatcagcgtgttccagtcctgatgatagccttcacgcggatcgctgtgttcatacaagttcgtgccatcaaattcggcaagcgcaaagtcatcagtcgggaagtggcctggcacccagtcgagaatcacgttcagaccagctgcgtgtgcggcatcaatgaaataacggaagtcgtcgcgagtaccaaaacggcgggttggcgcatacaggccggttggctgataaccccaactgccatcgaagggatgctcgttaatgggcagtagttcgaggtgggtaaagcccatccatttagcataaggcaccagttgatcggccagctcgcggtagctcaaccagaaattgttgtcggtgtggcgacgccaggaacccaggtgaacttcataaatagagattggcgcatcaaactgattcgcttttttgcgctcttcagtctgtacaaccttttccggcagcccgcaaataagagacgcggtttccgggcgcatttgcgcttcaaaggcataagggtcggacttcagacgcaagttgccattggcatcaatcatctcgtatttatagagctgaccgttatgcgccccagggataaacagttcccagatgccgctctctttacgcaggcgcatcgggtgacggcgaccgtcccagtagttgaattgcccaaccaccgagacccgacgggcgtttggagcccagacagagaaacgcgtacctgtgacgccatccatagtatctgcatgcgcgcctaaggtttcatacgggcgcaggtgagtaccttcagataatagccaggcatccatttcctggattagcggaccaaaacggtaaggatcatcaatcaggttttgctgaccatgccagacaacagccaactgatagcggaaaaaattcttacgtcgcggaatgacgccgctaaagaatccccgtgagtcgagacactccagttttgcgagtttgcgcccggttttcggttcaatcacccacacatcggtagcgtcgggtaaaagggcacggacttccagtcccgcggtggttttatgcattcccagtacggaaaaaggatccgcaaaatggcctgcaattagcgcgttaatcacgtctctatcgatacgatcggacatgcttgtcttcctgttttattgtgtcaccccatccaattggatttttgacttctggttgtgacatttttttgacctgaacggcgcagcactctgtgcatcctctctgcgtcgtcctcacttcaggtaaggctgtgaatactcatgtattcagccacccttaaagaatagccaatgctctatttaactcccggtaaatcatgaaacatctgcgcttactcctgtattacgcactaacaggggcggcatcgcgccccagatttaatgaataaagattacgccagttgacgaagcatccgacgcagcggctccgcggccccccacagcagctggtcgcccacggtaaaggctgacaggaactctggtcccatattcagcttacgcaggcggcctaccggcgtggtcagcgtgccggtaacggcagctggggttagctcacgcatagtgatttcccgatcgttcggaacgactttcgcccacggattgtgcgcagccagcagttcttccacggtcggaatagacacatcttttttcaatttaatagtgaatgcctggctgtggcagcgcaatgccccgacacgcacacataaaccatctaccggaattacggaagatgtgttgaggatcttgttggtttccgcctgccctttccactcttcgcggctctgaccgttatcgagctgtttgtcgatccacggaatcaggctacccgccagcggcacgccaaagttatccaccggcagctcaccgctacgggttaaggttgtgactttgcgttcgatatcgagaatagcagaggacggggtcgcgagttcatctgccacatggccatacagatggcccatctgggttaataactcacgcatatgtcgcgcaccaccgccggaagcggcctggtaggttgcaacggacacccaatcaacaagatcattggcgaataaaccacccaacgacatcaacatcaggcttacggtacagttaccgccaacaaaagtcctgatgccattatttaatccgtcggtaatgacgtcctgattgacggggtcaagaatgatgatggcgtcatctttcatgcgcagagacgatgctgcgtcaatccagtaaccttgccatccgctttcacgaagctttggatagatttcgttggtataatcgccgccctgacaggtcacaatgatatcgagggcctttagcgcctccagatcaaaggcatcctgaagtgtgccagtggttccgccaaaagacggcgcagcctggccaagctgagaagtagaaaagaagacagggcgaatggcgtcgaagtcgcgctcttcaaccatgcgttgcatgagaacggagccgaccataccgcgccagccgataaaaccaacatttttcataagcgtttttttcctgcaaagatgtgtgctgtataaatgtgccggtctcctcttggcacatctttcaccatacaaaaagcagccaaagtcgcaagtgaaattaatcaatgatagcgaagccatcagtaatgcgacttatcctgctttgttagcacgcagaaagtccgcggcaattatcagggaatttgagttatgaatgaaatcatttctgcagcagttttattgatcctgattatggatccgctcggaaacctacctattttcatgtccgtactgaaacatactgaaccgaaaagacggcgggcaatcatggtgcgagagttgcttattgctctcctggtgatgctggtgttcctgtttgcgggtgagaaaattctggcatttcttagcctacgagcagaaaccgtctccatttctggcggcatcattctgtttctgatcgccattaaaatgattttccccagcgcttcaggaaatagcagcgggcttccggcaggtgaagagccatttatcgtgccgttggcaattccgttagtcgccgggccgactattctcgccacgctgatgttgttgtctcatcagtacccgaatcagatggggcatctggtgattgctctgctgctggcctggggcggcacctttgtcatcctgctacagtcttcgctatttttacgtctgctgggcgagaaaggggtgaacgcacttgaacgcctgatgggattgattctggtgatgatggcaacccagatgttcctcgacggcattcgaatgtggatgaaggggtaacgaggagagtttttcgaaaagaacccggtagcgtcacaactaccgggcgaacaaacttaactcaacagctggaacgcaatcatcccaacgatggcaccgacagtgccgaggatggtttccatcatggtccaggttttcagcgtttcggcttcggtcgcgccggtaaatttaccgaacaaccagaaaccggcgtcgttaacgtggctgacaacaatcgaaccaccagcgatacaaatcgacagcgccgccatttgcgcaccggagtagttcagttgttcaataaccggcatcaccagtcctaccgccgttaaacaggctacggtggcagaaccctgaatgatgcgcactgcagctgccagcacgaagcaggtgatagcaatcggcaggcccatgccggttaacgcttcgcccagtgccggacctacgccagagtcaaccagcacctgtttgaacacgccgcccgcaccaatcaccagcagaatgatccccgccggttgcagcgcgtgaccgcaaatctccatcactttgtcttttggcatgccctgacgcattgccagaccgtaaatcgccaccagacaagcaaccagaatcgcggtaaacggatgaccgataaactcaaaccattcgtaagcagttgatccttccggcacaaaacgcgcggcaatggttttcagccctaccagcaccagcggcagcaggatcagcgacaggctgaatccgaaagatggcattttgccttcgccgagatgcggttcgctgatgtcgtcaggaatatgcagctcaacgtaacggctgatgaagttaccccacagcggcccggcaataatcattcccggaattgccgcacacaggccaatcaggatcatccagccaaagtcggcattcatctgcgatgccagcagcatcggcgctggtccaggcaccagaaatgccgccgctgccgccacgcctgcaaataatgggattaccagcttcaccaggttcgtaccggtgtggcgcgccattgagaaagcaacgctaatcagcagaactatcgccacttcaaagaacagcggtagcgcacagaccagccccgcaaggccgatggcataatgcgcgcggctgtgaccgaaggatttgagcattttgacggcaatctgatcgactgcgccggtttcatgtaagatcttgccaaacatagctcccagggcgacaaccaccgccaggaagccgagggtgcctcccatccctttttccatcgtcgctgcgattttatcgagcggcataccagaaaaaaggccagcccccatggacaccaccattaaagccaggaaagcgtgcatacgcgccttcatgactaaaaacagcagcagtaaaacagaccctactgctgttaaaacaagcgttaatgtagtcactacttatttgccttttttaataacctcaatggtgcttgccacaacaccttccagcggttgatcgatatccaccaccagtacatcggtttcgtccgcacccggctcctgcagcgtttcaaactgcgtcaccaacatttgggttttaaagaaatggcctttgcgcgctttcaggcggctttcaatcacatcaaaatcgcctttcaaatagatgaaagagagattcggattaccttcacgcagcaagtcgcgatagtgttttttcaatgcagaacagacgatcagcgacactttattagtgcgctgcatagcaaacgcggcgtcgttcagcgcctgcaaccacggtttgcgatcgtcgtcattcagtggttcgccagacgccattttttcgatattgcgccgtggatggaggaaatcgccatcaagaaacgcggcatgaagttgatgcgccacttcactggcgaccgcagatttgccgctgcccgatacgcccatcaagacgtaaatgtggtgatcatggttagtcgtgctcaaagtggtgcccccacaatacaagaattaaaaatgttacgggtaactgttatcggtaacattgtccagccggacaatatcagaagcaatatccatccatgccttaagtgtataagtgtgagctacttcaaatttgtgggcttaaatagatccgcccggtgacaaggtgaaacctaaatctaacattttcggtgtcacagattcgccacgaatacgcgccagcaggcgttcagcgccaatactgcccatccgctcacgcggcgtcagcacgctcgcaagtcgtggctccatcacctgaccaatgtcatgaccgtggaaaccggcaatcgccatatcgtcaggaacttttaaccccagacgctgacattcaaacgccgcgccgaccgccaggtcatcattcgtacagaacacgccatccagctgcggatattcccgccgcgcctggcgaatcagttcaataccggaagagtaagaagaagattgctcaaccatcacgctatatggcaccaggcctgcatccagcatcgcctgttcgtatcccttctgtttgatgatagtacgttcgtcgagacgtgcgccgagataggcaatgtggcgatgcccgcgagcaataatggcagtggtcatctggcgtgctgcttcaaagttatcaaaaccgacggcgatatcaaggcatggcgacttgctgtccatcagttccaccacgggaatacccgccacttcaatcatctttaaggtgcgcggcgtgtgggtacgttcggtgaggatcaggccgtcgatattccaggagagcatggattcgaggcgttcttgctccatttccggtttataaccgtagtgcgccagcatggtctgataaccgtgcgcgtcggtgacgctttcgattccgcgtaatacttccgcgaaaacctggttggtgagagaaggtaacaggacgccaatcgcccggctggtggcgttagagaggatatcgggcgcacgattgggaatatagcccagttcatcaagagccgcggcaatcttgccgcgtagagcgacggaaacctgctccgggttgcgtaaaaaacggctgaccgtcattttggtcacgcctacacggtcagccacatcctgaagtacgggtcttttctttttcatcgtcctgaaggtacaaaagagatagattctcttagtttaacacggacacatcagaaccttcccggggaaaacagtgcttgtttacaattattagatatacactaaatcaattgcatcgcattgtgctaacgacgcggcaaaaccccggaagcgtacatcagcacgcgaccggagcgagcgaggaagcctgcaaaaaggcaggcttcaaagatgccgttgagttttaaaccggcggcagatcgaacagtaacacttcgctgtcgctatccgcatggatggagattgcctgctcatcccagattgccagaccatcgctggtcgaggctttcacgccgttaatggtgacattgcctttcaccacctggatccagacgcggcgttcagcggcaatctgatgcaccgactgctcatctttcagcaacgcccagcggtacagttccatatcctgatgcactttcaatgaaccatctcgcgcatccggcgagagcaccagctgtttgccctgtacggcatcgaagcgacgctgttcataacgcggcgtaataccgttttcttcaggcatgatccagatctgatacagatgcagacgctcggtgctgcttgggttgtactctgagtgacgaatacccgtaccagcactcataatctggaactcacccgccggaacctgctctttattgcccatgctgtcctgatgctcaacagtaccttccagcacgtaggtcaaaatttccatatctttatgcgggtgagtgccgaagccctgccctgcttcaatcacgtcgtcgttaatcacgcgcagcgcggagaagcccataaagttcggatcgtaatagttggcaaaagagaaagtatgccaggagtccagccagccatgatttgcatgaccacgttcatttgctttgcgtaagtagatcatttgtattcgccccctgaatgatttcgatgggcttagtgtggacccgatctgcctgggatgatagagggtgaaaattgacccctctgttcaaaaaaattgaactattcgaggggccatcaaacttacttagcgagagttactgtggagggagaggcttgctcaaatccgcgttcaaggatttccagattggtaagaacttcagattccttgacgtaatttggcgcaccgtgggtgatggtttgatacaacgcatcataaacgcgcccgtaatcgcccatctccggcttcatctcttctctgaccgtcacgccctcgtcattgacatactccagcacaccgaccgaatcatccgctgcgaatcccggttcgcccggcataatattagccttcaggctggtttcctgctggtcgataccgtatttaataaacgaacctttcttaccgtgaacgataaatttcggataatcgattttcaccagatggctggttttgacgatggctttcaggtcgccataaaacagttgcgcttcaaaggtgtcgtcaggattggctttattacgcaggctgcggatgtcataagcgacgtgatccgggcgaccgaacagagaaataatctggtccatcgtatgcacaccaaggccataaaacgcgccatcctgcggcagcccaggtttggtttctgccaccgggcggtaatagtcaaaatggctttccacttcaacaatctctcccaacttgccactttcaatcgcttttttcgctgtcaggaagcaggagtcaaagcgacgattctgatacggcgtgacggtcagccctttgcttttcgccaacgcaaacagctctttcgcctgcgcaagtgtcggagtgaacggtttttcgaccagcacatttttcccggcttccagcgcgcgtttcgcgtactcgaaatggctgtccgcgtgggtgcagacaacaaccagcttaacatcgggatcgtttagtacttcgtcgagatcgctggtgaaatggatatgggaataaatgggagcctgttcttccggcttcgcatggcgacgaaaaatatgcgcgacatgccagctatccttgcggttaagtacatacggcagatggtaacgggtggtgcttttgccgaagccaataaaggcgcagttgatgaccatgatttcgtcctttttaaggtggttatttacaccttagcgcaaagcggacgtggttcctactggagtgcgcataacgaacacaagcactcccgtggataaattgagaacgaaagatcaaaaaaaaagccagcacccggctggctaagtaatactggaagcaatgtgagcaatgtcgtgctttcaggttctccgcgagggtcttcctgatcgcgagacaataataatcattctcattcgcacttgtccaacactttttgcaaaaaaatgcatttgactcgcatttgaaagtcaatgatgttgaaagggacatttaccccaaagaggacaaaggaatgagtgagatagtaatacgccacgcagaaacacgggattacgaggccatcaggcagattcacgcccagccggaggtgtattgcaacacactacaggtgcctcatccttccgatcatatgtggcaggagcgactcgccgatcgtcccggcatcaagcaactcgtcgcctgtattgatggagacgtcgtgggccatctcaccattgacgtgcaacagcgcccacgccgcagtcatgttgccgattttggtatctgtgtcgactctcgttggaagaaccgcggcgtcgccagcgccctgatgcgagagatgattgaaatgtgcgacaactggttgcgggtagatcgcattgaactaaccgtgtttgtcgataacgccccggcaattaaggtctataaaaaatacggctttgaaattgaagggactggtaagaagtacgcattgcgtaatggtgaatatgtcgatgcatattatatggcgcgggtgaagtaagatagtgccctttttctgagatggaaaaagggtgtcattcaaaatcgacataccttcctttaaggtatttatttgcccaatacatatattgagatttaactcataattacttcctaaagtgtaatattttattttttaatatatacgcctacaatttcctggagtaaataaataacaattaacaagcataatattgccattgataaaatagcatgccataaaaggacttttcagggatgagtaatattgtttacctgacagtaacgggagaacaacaaggaagcatctccgcaggttgtgggacttctgagtctacaggtaatcgttggcagagcgggcatgaggatgaaatatttacattctcactcttaaataatattaataatacggggcttggttcacagttccatggtataacattttgtaaattaattgataaaagcactccattatttattaattccattaacaataatgaacaattatttatgggatttgacttctatcgaataaatagatttggtagattggaaaagtattattatatacaactaagaggcgcttttttatcggctattcatcaccagatcattgaaaaccaactggatacagaaacaataactattagttatgaatttatcctctgtcaacatcttatcgcaaataccgagttcagctatttggcactccctgaaaattataaccgtttgtttttaccaaattcaaaaaaccaaacaaataatcgtttcaaaacgttaaacagcaaagctattggcaggctacttgctgctggtggcgtatacaatgggaacattgaaggattcagagatactgcggaaaaactgggtggagatgcaataaaaggctatgatcaaatactaaatgaaaaaacagcgggcatagcgatagcaacagcatctattcttttaacaaagcgttctaatgttgatacatatacagaaataaatagttacttaggcaaacttagaggtcaacaaaaacttcttgatggtatagacataatagaaataatatacattaagagaccttcaaaagacttagctaacttacgaaaggagtttaataaaactgtaagaaaaaattttcttatcaaacttgcaaaaacctccgaagcatctggaagattcaacgccgaagaccttttaagaatgagaaagggcaatgttcctctaaattataatgttcaccataaactatctctagatgatggtggtactaatgatttcgaaaatttagtattaatcgaaaacgaaccatatcataaagtttttactaacatgcaatcacgaatagctaagggaatattagtaggtgaaagcaaaatcactccctgggccattccatctggctcaatttatcctcccatgaaaaatattatggaccacacaaaatgatgactaaaacccaaataaataaattaataaaaatgatgaatgatttagactatccatttgaagcaccgctcaaggaatcatttattgaaagtataatccaaatagaatttaattctaattcaactaattgcctggagaagttatgtaatgaagttagtattctttttaagaatcaacctgattatcttacttttttaagagcaatggatggattcgaagttaatggattacgattatttagcctctcgattccagaaccttcagttaaaaacctttttgccgtaaatgaattttatagaaataatgatgatttcataaaccctgatctacaagaacggttagtgatcggggattatagcatttcaatatttacttatgacattaaaggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccgacattaaaagtaacttttttgaaattagagataatattggcacagaaaatatattcagttcgtttagtgatttctcttcattcttaaacgaaatcatggacagttgttcataataatcaaaaggaaacaaaaatcattgtaaaccatgccatctttttagagattaccagcagaaaattccttgttcgaaatttagcagtgcaagctatggaaaaacttacaacggaactacactccttaagtgagatggaccgaagacatgtagtctctattttagccgaaatagctaatggctatgatgattttaatgacatgttgatttatttagaattttacccgaatcataagattctgatatcttaaataagaaaatcccgttcgacgttctgaaaaagaaatcataaaatattagcagatacttatttcgtgactatatcttatccgatgaacttttttcaaaaccagcatttaataatatctttgacgaagatgaacgcgtctttgctcaatgtatcacacaggaataataatataacactcaacaataatatttattataattatgattacttatcacgacgcattcgcgaaagcgaaccattaccttgatgatgcagatctcccggtcgtcattactctacatggacgctttagccagggctggtatttctgtttcgaagcacgagaatttctcgaaactggagatgaggccgcgcgcttagctggtaacgcaccttttattattgataaagacagtggtgaaattcattctctgggaacggcaaaaccgctggaagaatatctacaggattacgaaataaaaaaggctaccttcggcttgccctgacaaaatagccctcttcccacgaagagggccgctaaccttagtaccccgccgttaaatcatccaccgagcgcgggtcggatgcgccgtacaactcaccgtccggcccaaccataatgctttgtgtactgcccatcgcctctttcagcgccactttctgaccttttgcttccagcagcttgagcgtatccgggctaaaccctttttcgacacgcagctcgtccggcaaccactgatggtggaaacgcggcgcattggtcgcttcggcgacgttcaagccataatcgatgctattcaccaccatttgcagcactgtagtgatgatccggctaccgcctgggctaccggtaaccagccaggttttaccgtctttcaccacaatggtcggcgacatcgacgacagcgggcgtttgttcggcccgacggcgttggcatcaccgcccaccagcccgtaaacgttcggtacgcccggtttggcggagaaatcatccatctggttattaagcagaataccgctctcgcccgcgacaatgcccgtaccgaaggtggtgttcagcgtataggtcaccgccaccgcgttaccatctttatccaccactgagtaatgggtagtttgattactctcataaggcgcaagcttgccggggcgaatttcgctggatggcttcgctttattgatatcaatttgatcggcaatagatttggcataggctttattggtcagcgcctgccacggtactttgacaaaatccgggtcgccaagatattccgagcggtcggcgtaggcgtatttctccgcttctgccatgatttgcatcgcatcggcgctgccaaagccgtatttcttcatatcgaagttttccagaatattgaggatttgtacgatatggatcccgccggaggatggcggtggcatggagtaaacctgatacccgcgataatcgccgcttatcggagtgcgttcgaccgctttataggctgctaaatcttctttagtgatcaagccaccgtttttctgcatctcctgggcgatctgttccgcaatcgtgcctttatagaattcgtccgggccgttttcagcaatcatctccaggctctttgccaggttcgcctgcaccagcgtgtcgccctttttcagcggctcgccctctttccagaagatagctttactgttttcgtgattcggcaacacttcgctaccgtaggttttgagatcgtcagccagcgcgtcgttaacgataaaaccatcgcgtgccagtttaaacgcgggctgcacgactttgttcagcggcatggtgccgtatttatccagcgccagcgagaaacctgctaccgtacccggtgtgccggaagccagatgcgaagtgagtgattttttgctgtccgggttgccctgatcatcgaggaacatatcgcgggtcgctttggcgggtgccatttcgcggaaatcgatagccgtggtattgccatttttcgagcggattaacataaaaccaccaccgcccagattccctgcctgcggatgcgttaccgccagcgcgtagcccaccgccacggcggcatcaacggcattcccgccctccttgagaatatccacccccacctgagtggcagtggcgtccacagacgctaccattccctgtttcgcgcgtaccgggtggaagacatcttcctccacaccatacgagacgggcggcgcaggaggcgcggcggcggcgctaaaacaacttcctgagagcagagcagcaatggccacccggcgtaaaaacgtcggttttatcatcgttattctccagagattaaggggcaaccccagctaagcctggtatataactctgaattaatcatcgttttgtcgggaagcgagtaaacttaaaggatatcttcagaggaggatacgcgatgaaacgacttctgattcttacggcactcctgccgtttgtcggctttgcacagcccattaatactctgaacaaccctaaccagccggggtatcagatacccagccagcagcggatgcaaacccagatgcagactcagcaaatccagcaaaaagggatgctgaatcagcaactgaaaacgcaaactcagttgcaacagcagcatttagaaaaccagataaacaataattctcagcgggtgttgcagtcacagccgggggagcgaaatcccgcccggcagcaaatgctgcccaacaccaacggcgggatgttaaacagcaaccgtaatccggatagttcgttgaatcagcagcatatgctgccggagaggagaaacggcgacatgctgaatcagcccagcacgccgcagcctgacattccgttgaaaactattgggccgtaaagttcggaccaatcacgtcaatcgcatcggtacagatgcaatccacaccccagcgcagcaactctgctgcgcgctggggtttattgacggtataaaccagaatccgcagtccggcgtctttcaactgcatcactcgcgctttattgagtaacttatgattgagatgaatagagacgcagcccagccgcgcggtcagttcgcgccagtcgtcgcgccactcatccagcaacaaaccgcgcggcagttccggtgccgcctgttgtgcagcttctaaagcatcaatctcaaacgatgacagcagcggcggcgtcataccggcccacagctcgcgtgccgccagcgccaccattttgcccgttaatggcccggtgccggtggtgggtttgatttcgatattcgccatcatcccgtgttcgcggcaacgttccgccacctgcgaaagcaacggtagcggctcacctttaaacattttgctgtaccaactgcccgcatccacgcgcagtaaatcctgccagttcagttcacccgcgacgccccagccgttgctggtacgttcgagattgtcgtcatggagcaggaagatctcgccatctttcgataacttcgcgtcaaattcgatcatcttatgaccgtattttgccccgacgtcgattgacgccagggtgttttccggggccagcttaccgccgccacgatgagcgacgatgcggggataaggccagttactcatactcgttgtcctgtttcaccatcaaaaagatgcagctgattttccgccagatgcagccacagcgtgctgcctgccgtcgggcgctcctgatgcgccagtcgcaccaccagcttctgctcgccccagcgtccgtgcgccaggttatctgcgccgaggatctccagcgtgtccatcaccatcggtacgccgccttctgcctgcgagcttagcgcaatatgttccgggcgaatgccgagagtcattttacgcccggcatactgacggtagccaccgtttagcggcagctcaataccgccgtccagttcgaaatgcgtgccttcgttattcacgcggcctgtcagcaggttcatcgccggactgccgataaaactcgctacaaacaggctggcgggcttttcgtagacttcaactggtgtgccaatctgttcggcaacaccgccgttcatcaccattactcgctgggcgagcgtcatcgcttcaacctgatcgtgagtaacgtagagtgaagtcgttttcaggcgacggtgcaactgttgcagttcaagacgcatctgcacgcgcagcttggcatcgaggttagagagcggctcatcaaacaggaacaccgccggatcgcgcacaatcgcgcggcccatcgccacacgctggcgctgaccgccggaaagctcgcgcgggcgacgtttgagcagaccgtccagctccagaatgcgcgccgcttctttaacgcgctcggcaatttgctgcttgcccatgccgcgaattttcagcccccacgccatgttttcttcgacactcatatgcggataaagcgcgtagttctggaacaccatcgcaatcccgcgatcttttggctccatttcagtcacgcgctggtcgttgatccagatatcgccttctgtcacccgctccagcccggcaaccatgcgcagcagcgtcgatttcccgcagccagacggcccgaccatcacgataaattcgccatccgccacatcaagggtcagcggtttaatgacctgggttttaccatcccagcttttggttactgcctgtaatttcagtcctgccatcttatttctcactatcgaccaggccgcgcacgaaggcacgctgcatcactaaaacaatcaccaccggagggataagcgttaacaacatcgccaccatcactgagttccattccgtggtgccttcgcctgtagcgatcatccctttgatccctgccacggtggtgccgagatccacatcggtaataatcaacaacggccacaaatactgattccagccgtagataaaggtgatcacaaacagcgccgccagattagttttggagagcggaaaaacgatgtcgcaaaagaagcgcattggcgatgcgccgtcgatccgcgcggcttccaccagctcatccggcagcgtcataaagaactggcggaacaggaaagtagcggtcgccgaggccatcagcggcagcgttaaaccggcgtagctgtcgagcatctgcaggttggcgatgacttccaccgtcgggaagatacgtacttcaaccggcagcatcagggtgataaaaatcatccagaagaagaggttacgtagcggaaaacgaaaccagacaatggcaaatgccgagagcatcgagacggtaattttgccgagcgtaatgctgaacgccatcacaaagctgttaagcaacatccgccagaacggcgcgctattcgtgcctaccccgttcacccagatgttgtggatgttttccagcagatgtgtgccggggatgagcgtcatcggcgcggcatagacggcctgtttatccagcgtcgccgcgacaaacgccacgtacagcgggaagaggatcaccgcgatcccgaggatcagcatggtatggctgaatatcgtcagccacggacggttctcaatcattggtaacgcaccttgctttcaacatagcggaactgcaccaccgtcagcacgatgacgaggaacatcaacaccaccgactgtgcggcagacgaagccagatccagtccggtaaaaccttcgcggtagatcttataaatcagcgtcgtggtggcctgaaccggcccgccggacgtggcggcgtcgatcaccgggaaggtgtcgaagaaggcatacaccaggttcactaccagcaggaagaaactcaccggggcgataagcggcagcgcaatcttaaagaagcggcgaatcggccctgcaccgtcgatggctgcggcttcgatcaacgaacggggaatggattgcagcgcggcatagaagaacaggaagttgtagctgatttgcttccatactgaggcaaacaccaccagaaacattgcctgaccgctgttttgcgcgtggttccagtcgtagccgaactccgcgagaaaatgggtgatcagcccgcgaccggggttaaacaggaagatccacaatacggcggcaacggcgggagccacggcgtaaggcagcaacattaaggtttgatagaaacggctgccgcgcacgatgtactccaccagcgccgcaaagaacagcgataccagcaaaccgctgacggtgacaaaggtgctgaattttatcgtcgtccagaaggagtcgagatagtagctgtcatggaacagcgtgacgaagttatccaggccgacaaactggctggagaaaccaaacggatcgacgctttgtagcgagtaccacaacgcttcgcccgcaggccagataaaaaagataacggtgatgatgagctgcggcgcgaccagcagataaggcagccagcgcgagcggaacaccggacgggatgatgacattacggttaattcctgaactgtgccggatgcgcttcgcttatccggcctacacgcgatgccaggtcagataagcgaaacgcatccgacattacactgattaagacttcgtcgatttctcaaagcggcgcagcaactgatttccacgctcaacggcggtatccagtgcctgctgtggtgtcttcttaccggtccacacgctctccagctcttcatccacaatcacgcggatctgcggcatgttgcccagacgcagccctttggtgaacggcaacggcggcttattcagcatctgacgcgtcgcggtatccgcccctgggtttttctcataaaagccctgctcacgggtcaggtcatacgctgctttggtgattggcagataaccggttttctgatgccactcggcagcgttttctggcttcgcgaggaaatcgaggaacttcgccacaccggtatacgtttctttatctttaccctgcatcacccacaggctggctccgccgataatggcgttttgtggcgcatctttcgcatcggcgtcgtaaggcatcatgcctacgccgtagttaaatttggcgtactcgcgaatgttggcaagagaaccggaagaggcggtggtcatcgcgcaatcaccgttatagaacttctcggtggattcatccttacgaccgacgtagctgaagtcgcccttcttgttcatctcctcgagcatggcgatgtgtttcacctgctccggcttattgaactccagcaccgcgtccgtgccgtcaaagccgttgtttttgctggcaaacggcagaccgttccaggcgctaaagttttccagttggatccagccctgccagccgctggcgtagccgcacttcatgccggaggctttcagtttcgcggcatagtccgccagatcctgccaggttttcggcggctgttccgggtctaatcctgctttcttgaaggcgtctttgttgtaatagagaacgggggtcgagctgttgaatggctgggagagtaagtggcccgttttgctgtcggagtagtaacctgaaaccgtcggcacaaactgcgactcatcgaactgaatccctgcctctttaaacacgtcatacaccggtttaatggctttcgacgccatcatggtggcggtgccaacttcataaacctgcaaaatagccggcgcgttgccggtacgaaatgcggcaatccccgcgcttaaattctgttcgtagttgcctttataggtcggtacaattttgtaatccgggttttcggcgttaaaacgttgggccagagaatccacctctttacccagttccccttccatagaatgccagaacggaatggtcgtcactgcctgtgcattccccattaacgccagtccgagcgccagtgctgaagctgtataatgtaacggtttcatcgtttatctctcttgttgtaccgaatgcgcgaattcacgcgttttatgctcgcggggtaacatgacatgctcgaattacagaaaaataacttttttgttacatttgtaagatagtaaggtgtcagaaagatgacaaggcggtgacggcgtgggtgagggaaaatgggagatggggcacggataagcgggaaaatatagaaggtctgaatcaaactctacagattgctcatcgtttcatgccggatgcggcgtaaacgccttatcaggcctacaagatcgtgcaaattcaacatattgccactcacccagtaggcctgataagcgcagcgcatcaggcaattttacatttgtcacctgtctcaaaggagtcttttgactccctatcaatcaacgtgttattacccgcctaaatacgcacttctcaccgcttcattcgccagcagcgcatcaccagtatcggaaagcactacatggccgttttccagcacgtagccgcgatccgccagctttagcgcctggttggcgttctgctcgacgagaaagatagtcatcccctgctcgcgcagctgctcgatggtgtcgaaaatttgctggatgataatcggcgcaagaccgagcgatggctcatcaagcagtagcaaacgcgggttgctcatcagcgcacgaccaatcgccagcatctgctgttcaccgccggacatggtgcccgcccgctgaatacggcgctcatgcagacgtggaaacagctcatacacccactttatgcgctcctggaactggtcgcgttcagcaaaaaaaccgcccatcgccaggttctcttccaccgtcatccgcgagaagacgcgacgcccttccgggacaatcgccaccgcttcgcgcatgattttcgctgtctgccagtcggtaatgtctttatcatcaaacacaattcgcccgctggtggcacgcggatcgccgcataacgtgccgagcaaggtggttttccccgccccgttcgcgccaatcagcgtgacaatctcgccctgattgatatgcaggctcacctcatgcagcgcctggattttgccgtagtgggcgctgactttgtcaaaggacaacatgactttttccatcttatgcctcacctaaataggcacggatcacgtccgggttattacggatctgctccggcgtaccgtttgccagcggcgtcccctgattgaccacgtaaattcggtccgaaattcccatcaccagcttcatatcgtgttcaatcaacaagatagtggtgttgtgatgattgcgcagttcggcaatcagctcatccagctctttcgtctctttcgggttaagacctgccgcaggttcgtcgagcattaaaatctccggctgcgtcaccatgcagcgggcaatctcaagacggcgctggtcaccataggccaggttactcgcctgacggttggcgtgttccagcaaaccaatgcgctcaagccaggtcgcggcgcggtcgagcgcttcgctctgggcgcgacggaaggatggcgttttcaacaggccagagaacagcccggttttcagttgctgatgctgcgccaccagcaggttttcaattaccgtcatttcacggaacagacgcacatgctggaaggtgcgcaccacgcccatgcgggcaatttgctgccccggtaaaccttccaggtgctgatcgcgcagtaaaatggtgccgccggtgggtttgtagaatccggtcagacagttaaaaaccgtggtttttccggcaccgttagggccgattaacgagacgatctcctgcgggtacagttcaagattgacgttgttcaccgccagcaggccgccgaagcgcatcatcaggccgttaacagataataatggctgactcatgcctgctctcctttcgctgcgccgtttttcagcttcagttgcgggcgcgtcatgggcagcaagccctgcggacgccagatcatcatcagcaccatcaaaccaccgagcattaacatgctgtattcgttgaaatcacgcatcaactcgcgcgacaccaccagcaaaattgccgccagaatcaccgcaaattgcgagcccataccgccgagcaccactatcgccagcacaaacgccgattcggcaaaggtgaaggattccgggctgacaaagccctgacgcgccgcaaacagcgttccggcaaaaccggcaaacgcggcacttatggtaaaggcagtcagcttgatacgacgcgggcttaagcccagcgaacggcaggcgatttcatcttcacgcaacgcttcccacgcacgccccagcggcatccgcagcaggcggttaatgacaaacaggcttagcaccaccagcagcaacgccaccaggtagaggaagatgacacgatcggagggatcgtatttcaggccaaagaaattactgaacgtgtcccagccgccttcacgagcggtacggctgaactcgagtccgaagagtgtcggtttcgggatctgactgattccgttcgggccgccggtaatttcggtgttattgagcagcaatatgcgcacaatttcgccgaaaccgagggtaacgatcgccagatagtcaccgcgcaaacgcagcaccggaaaaccgagcaggaagcccgccgccgctgccattaatccagcaatcggcaggcaggtccagaagcccaagccgtaatagtgattgagcagcgcaaaagtgtaagcgccgatggcgtaaaaaccgccgtaccccagcaccagcagaccagaaagaccaacaaccacgttcagcccgagaccgaggataatgtagatcatggtcagggtggcaatatccaccgtcccgcgtgaaaccataaacggccacgccaccgcaagcaccaacagcgccacgaggaacagtttctgcttcaccgtggagccatcaatggcgggcagaataaacttcggtccggaaacgcttttcaaccctttctggaaagccggtcgcaaaagctggaagaaaaagaccaccgccgtgccgataaacacccactgccaacggacatccgaagccgtgtcgaccaccagtttggtgccatccagctccagttgcacgcccataaagacgcccgccagcacaaagaacatcgcggcagagagcagcgccattgcaatatgcatcggtttcatactttctctacctccgggcgacccagaataccggtcggcatcaccagcagcaccagaatcagcagggcgaatgagaccacatctttatattccgtactcagataggcagaagagagcgcctccgcaatccccagaatcaggccgccaatcatcgctcccggaatgctgccaatcccaccgagcaccgccgcggtaaaggctttcatcccggccataaagccgatgtaggggttaatgacgccgtagaactgaccgagcagcacacccgccaccgccgccatcgccgcgccaatcacaaaggtcagcgcaatcacccggtcggtgttaatgccaagcagactcgccattttcagatcttccgcgcaggcacgacacgcgcgacccatgcgggaatagcgaatgaaaatcgtcagcgccagcatggcgaggaaggtaacaatccagatcaccgcctgcatggtggtaatagaggcagagaagttttcgctatgccccaccacccactgaccgttaaacaggctcggcagcgccacgtcgcgcgaaccttcggtcaggctgacgtagttttgcaggaagatggacataccgattgcagagatgagtgcaatcaggcgcttagagttacgcaccgggcggtaagccacccgttcgatactccagccgtaggcgctggcaatgacgattgcgccgacgaatcccgcagctaccagcagccagccggtatcaatgcccatcatcatcagcgcggcgatgatcataaatgagacgtagctgccaatcatataaacctcgccgtgggcgaagttgatcatgccgataatgccgtaaaccatggtgtagccgatggctatcagcgcgtaggtactgcccagcgtgacgccgttaaacatctgctgcaagaaatacaaaaactgctcagacataaggtaacctttctaaacccgcccgcattttacgggcggtgggatgatcacttggctgccgtggatgaaccgtcggcgtgccactggaagacaccaaaatcaaatcccttaagatcgcctttttcatcccagttcagcggcccaatcacggtgtttgcaccgttagcttttaaatctttcaccagcgccagcggctcatcgctgccggtacgctcaagggcagtcgccagagattgcaccgccgcgtaggtgatccagacataaggcccggacggatctttcttgtctgctttcagcgcatcaacgatgccctggtttgccggatcctggtcatagcgttttggcatagtgaccaacatgccttcggcggcatcaccggcaatgttcgacaacgacgcattacccacaccttccggccccataaactgggttttcaggccaacggaacgggcctggcgcagcatctgccccatttccgggtagtaaccgccgtagtaaacgaagtcgatgttttcttttttcaggcgggcgatcagcgcggagaaatctttctccccggcggtaataccgtcgaagaagacgacgttggcgttagccgctttcagcccgtcctgcaccgaacgcgccagcccttcgccatactgttgtttgtcgtgaatgatggcgatgcgctggggcttcaccgtctcaagaatgtattttgccgccgttggcccctgggaagagtccagcccggcagtacgcataatgtgttgataaccgcgttgggtcagctccgggttggtcgctcccggcgagatcatcagaataccttcgtcttcatagatatctgacgcaggctgggtagaagaagaacacagatgaccaataacgtatttaatgccgtcattaacgattttgttggcgaccgcaacggcttgtttcgggtcgcatgcgtcgtcatattccacgccaaccagtttatcgcccttaattccccctttggcattaatgtctttaattgcctgacgcgcgccgttaaattccatatcgccccactgggcaatcgggccggacatcgcgccgacaacggcgactttaatatcgtcagccatagcggtgtgtgaaattgccagtgcaatcatccctgcgatgatagttttcgcattccgtttcatagtcaaaaatccccattcgtgatgttgtgttgctttgtttttatgtgttaacaaatcagactgttctttttttatactgcactgtttttgcctgtctgattaaggggttagcgcagtattttgtgataatagcgattaaaatccctatttttcagtcgattaagaacagataatattctgaatttattgatagataaacagaaaaaagtgcctttgtcagcataaaataacggcacaaagggcggaataattcactatcattcaggggattatgctggacatttttcattctctaatgttttaattttgtaattattgctgttaaaaaattaatcacctgccaaaagaaataaaaaagagaaagcctccgattaaattatttcgctacactggttccacttttgtgatttacacgggttacccatgaagctgaccatcattcgattagaaaaatttagcgaccaagaccggattgacctgcaaaagatctggccggagtattccccttcctcgttacaggttgacgataaccaccgtatctacgccgcgcgttttaacgagcgcctgctcgctgccgtgcgggtaaccttaagcggcaccgagggagcactggattccctgcgcgtgcgggaagtcacccgccgtcgcggtgtggggcaatatctgctggaagaggttttgcgtaacaatcctggcgtttcatgctggtggatggcggatgcaggcgtggaagatcgcggtgtgatgacggcgtttatgcaggcgctggggtttacggcacaacagggcggctgggagaagtgttaatcgtcaagtttgatttcaaaagtgatattgcctgatgcgctacgcttatcaggcctacaatgtgtgttgcaatttactgatttctttggatcttgtaggccggataaggcgtttacgccgcatccggcatgaagcaacgtactcgatattagcaatttggcggcaacccaaagttgccgattaatgattacttcgcatcggtcgccgtgccgttggcgtgccagtcaaatacgccgaactcaaagcctttcagatcgcctttctcatcccaggtcagcggtcccattacggtatccacggagttcgctttcaggtatttggcgatttcagccggatcgtcagactgattcaggcccgcctgcaaagattgcagcgcggcgtaggtggtccaaacgaatgcgccacttgggtcctgttttttcgctttgatcgcgtcaacaatgggtttgttcgccggaacctgatcgtagttcttcggcttggtcaccagcagcccttccgctgattcgcccgcaatgttagacagcgaaacgttagccacaccttccggccccataaactgagttttcagccctgccgcgcgtgcctgacgcaggatttgccccatttccgggtgataaccgccgtagtaaacgaagtcgatattctcttttttcagacgcgccaccagcgttgagaaatctttttccccggcggtgatgccatcaaagaacaccacgtttgcattgcctttcttcaggccgtcctgcaccgctcgcgccagaccttcgccgtattgctgtttgtcgtgaacgatagcaatacgctgcggtttcactttctcaagaatatatttcgccgccgtcggcccctggtcggagtccaggccggtggtgcgcaggatcagctgatagccacgggcggtcagctccggcgcggttgccgctggggtgatcattaaaatgccttcgtcttcgtagatgtcagacgcaggctgcgttgatgaagaacagaggtgaccaatcacatatttaatgccgtcgttaacgactttgttcgccaccgcaaccgcctgtttcgggtcacaggcatcgtcatattttacgatttgcagtttgttgcctttaatgccgcctttagcgttgatatccgcaaccgcctgctctgcgccggtaaactcctggtcaccgtactgcgcaaccggaccggacattgcgcccacgaccgcgactttaatatcttctgccagagccatattgctgaatgccagcgcgatacatcctgccagtaacgctttaccctttatgttcatcctgagaatccccattcttctggttattacgtgtgttgtgatgttgtttttcagcactttatttcgttttatgcatgactacccgtgctttagcagcatactctgctaaaacatacccgatttttatgatattggaatagctattttgacagtttattaacaatctgcgtggggattggcgttttgccggaggggaaattgattattacagaggcccaaaaaacaaaaaccccggactctcatccagggttctctgcttaatagcggaaattacgcttcaatggcagcacgcaattttttcatcgcgttcttttccagctggcgtacacgctcagcggaaacgccgtaacggtcagccagttcctgcaacgtggacttgttgtcttcgtccagccagcgcgcacggatgatgtcctggctgcgttcgtccagaccctgcatcgcgtcggtcagacggtttgccgcctgctcttcccagttatcatcttcaatgccgtcggcaaagttagatgatttatcctgcagatagagcaccggagccatcggctggctgtcggaatcgtcgtcggaagacaggtcaaaggtcatgtcctgtgccgccatacgtgattccatctcacgtacgtctttgctggttacgcccagttcacgggccaccatttcgacttcatcctggttaaaccagcccagacgctgcttggttttacgcaggttgaagaacagtttgcgctgcgctttggtggtcgcaactttgacgatacgccagttacgcagaacgtattcgtggatctctgctttgatccagtgaacggcgaaggagaccaggcgcacacccacttccgggttgaaacggcgcactgctttcatcaggccgatgttaccttcctgaatcaaatccgcctgtggcaggccatagcccgcataattacgagcaatatgaacaacaaaccgcaggtgagacaggatcagcgttttagctgcttccagatcgccatggtaatgcagcttttcagccagcgcccgctcctcgtcagccgacaacatcggccacgcgttagctgcccggatgtaggaatccaggttgccaactggggctaaagctaaactttgcattttgtcagtcattcaaatcctctcaatcgatatcttctggcgcttcagtggtagcaacaactgtgccagagcttaagagcaacgaggttatcattcactgttttatcagaccgtgattttatccacaagttcaatgcaagcttgtgaataaattacgcacaaaatgtgacatagagatgaaataccgggaagagacaacggggtctctttccctgctacggaacccattgcagggaaagagtataacacgcttttattattcaggcgtaaagtggcgtaaatgttgtaccgtggcaagccacgctgccacccagccaatcatcgagcataccagcagcaatagcaggcattcatcgaatgataagccattgatatcaaacttcgttccgaaaacctgtgccacttccgcaaccgccgatgacaatcgcagcaccagaatttctgacaaaattaatgacaacaatgcgccagaaaatcccagcagtgcgccaccatacaggaacgggcgcaggatgaatccatctgtcgcaccaatcagtttctgtacgttaatggagtcacggcgagcaaagatactcagacgcacactgttaccgatgacgaggaacacggccgccaccatcaacacgccgatcatcgccgaaacgcgcccgaccagcccggtcaacgccgccagacgggcaaaccagctgtcatccatccgcacttcgtcaatgccgttaatctgcgtgatacgatcacgcagcgtattcagtgattccgtcccctggaaatcgagtttcgggatcaccaccgccactgccggaagcgggttttcttccagcatatccagcgcaccaccaaaaccagaccagttacggaactcacccagtgcgtcttcacgagaaagatagttcactttctccacgccttgctcggcctgcaactgtgccaccacgcccgcagcagcgtcatcgtccagcgttttttgcagataaacagtgatttgcggtgacggataatactgcgtcgccgcctggttaacgtttttgtacaccatataacagacgctgggcagcgtcagagaaatggcgataaccatcaccgttaaaaacgtggcgaacggtttgcttttcagatcctgcaatgcgccgtggaaggcatagcgcacctgttcgttgaaaacgttggttttgcgatttaccggttttggcgaggatttcgcgcgttttggtgcgttacgaccgccgtcgcctgagccgccgaccgatttacggaagcgatcaagacgcccgccaaactgccgaatatgattgattgcatcgcgcttattcatggcccacgcctccatgcaagtgaccatcgctcagggtgagcatgcgataggaacgccgcgagatcaggttgatgtcgtgcgttgccatcaatacggttaccccaacgcggttaaactcttcaaacagacgtaaaatgccttccgacagcgcgtcgtccaggttaccagtcggttcgtccgccagcagtaccgcgggcttgttcaccaccgcgcgggcaatgccaacacgctgttgttcaccgcccgaaagctgaatagggaagttcttcgctttgtccagtagcccgactttatccagcgccgccgacacccggcgacgaatatcgtcaccgctggcaccggcgataatcagcgggatcgccacgttatcgtagacagtacggtccatcagtagatggtgatcctggaaaatcatgccaatctggcggcgcagaaacggaacttcacggtttttcagacgcgtgatgtcatggccgctaaaccagattttcccggcgctgggccgctcaatcccacagatcagcttcaggagggtacttttccctgcgccggaatgaccggtcagaaacgccatctcacccggctgcatatggaacgtaacgccctgcagcgcctgtctcccaccgagataagccttgctgacatgttcaaagcgaatcattgttaatcctctcgggcaaaaagtgcctctataaagtcgtccgccttaaacggacgcaaatcctcaatacgttcgccgacaccaatgtagcggatagggataccaaactggtcagccaccgagaaaattaccccgcctttcgccgtgccgtccagtttcgttagcgtgatgccggttaagccaacggcttcatggaacagtttggcctggcttaccgcgttctgcccggtgctggcatcaatagtcagcataacttcatgcggcgcttcaacgtcgagtttcttcatcacgcggacgattttcttcaactcttccatcaggtgcgatttgttctgcaggcgtccggctgtatcggcaatcaggacgtcgatattacgcgctttagctgcctgaatggcgtcgaagataacagaggcggaatccgccccggtatgctgggcaatcaccggaatattgttgcgctgaccccagacctgaagctgttcaaccgcagctgcacggaaagtatcacccgccgccagcatcaccgatttaccctgctgctcaaactgacgcgccagcttaccaatcgtcgtggttttacccacaccgttgacgcccaccatcaggatcacaaacggcgctttgccttcaacattcagcggctcatcgactttcgccagaatctcgcccatctcttctttcagcaggccatagagcgcctcggcgtcacgaagctgcttgcgggatgcgccttccgtcagattggtgataattttacgtgtggtttccacacccacatcggcgatcaaaagctgctcttccagctcctcaaacagatcatcgtcgatttttttaccgcggaacaggctgataaatccggaaccgagattttctttggtttttaacaggctgcgtttcaggcgcgcgaaaaaaccttctttggtcggtttttcctgctcctgagcgatttcttccaccggctgctcttcttctgccggaggaaccaccatcaccgcctcttctgccgcttcggcagccagcgccgtttccagctcttcgtcggtaatttcttctttagccgcttcttcttccgccgcttcgacaatctctacggtttccgcttcagcctgccactcttctggcgaaaccgcttcggcgttgacgtcttccggcaacggcagctcttcacgttcgatagccactggctccggcgtttcttctacgaccggttccggctgtgcaacgacttccgcttcaggctgcgctttttcactttcagcaacctgttcagtgacttccacaacgtcggcagcaaaagtttccgcctcggcttcagtatgcgcttgcggctgctcttcaacggcttgttcagaggccttcacaggctcttgcgcctgaacgatttcttctacaaccggttgttcattctgaacttctgtctctttttccggggtctgctctttttgaccaaagcccagccaggaaaaaaagccacgttttttttctttcgccatttgcgactacactcctcgctgttgcttcatggcacagcgttaacgctatgtacatagcagctaaaaaaatgatgaaatagtctatcacttaacttaattcacatcaccgcctgcaagtatgtgttatctggcggattgagcaatttatcatgaaaaaaccgaatcattccggcagcggccaaatccgcattattggcgggcagtggcgaggccgtaaactcccggttcctgatagcccaggtctgcgccccaccaccgaccgcgtacgcgaaacgttgtttaactggctggctccggtcattgttgacgcccaatgtctggattgcttcgccgggagcggcgcgctggggctggaagcgttatcgcgctacgctgcgggggcaacgttgattgagatggatcgcgcggtttctcagcagttaattaagaatctggcgacactaaaagcaggcaatgcacgcgtggtgaacagcaacgcgatgtcattcctggcgcaaaaaggtacaccgcataatatcgtgtttgtcgatccaccgttccgccgtggcttgttagaagagacgataaatttactggaagataacggctggctggctgacgaagccctgatttatgtcgaaagcgaagtcgaaaacggtctgcccactgttccagcaaactggtcattacatcgggaaaaagtggcgggtcaggtggcttatcggctgtatcaacgcgaagcacaaggagaaagtgatgctgattaatattggtcgtttgttaatgctctgcgtttggggatttttaatcctcaacctggtgcatcccttcccacgcccgctgaatatcttcgttaacgtggcgctgatttttaccgtgctgatgcatggtatgcagctggcgctattgaaatccactttaccgaaagatggcccgcagatgaccaccgccgaaaaggtacggattttccttttcggcgtgtttgaactgctggcctggcagaagaaatttaaagttaaaaaataaccttattgttcgcctacaaagctgacaaagcgcgttcctttatagctcagcgtacctttatcgcccactgtcagggcgtggtactgctgggcgtcgaggcgaaacgtctgctccattcctccgctttgcggtttgaagcttgcctcatagcgtatactggtgcctgccggagtcacttcctgctggcgcgaacggcgatcgttaatcggtttttcccgcttgttgctcaccaccaccagcttttgctggagcggagccatatcattatcagctttttcccgtcgctgttgcataaaacgaaacgatgcggcgacgacaattaagccaatgataacaataaagaaaagaggtggtttgctcatctttatccctcatcggaaaatgcggaaataagcataccctgccagttatggtgttgtcatccgtccaccctcgccactaaactggaagcaagaccgtaggcattccgcttacgaaaaaataacgaattcaaggaactaagatgctttggtcgtttatcgctgtctgtctttccgcatggctatctgtggatgcatcgtatcgtgggccaacctggcaacgctgggtgtttaaaccgttaacccttcttctcctgctgttactggcctggcaagcgccgatgttcgacgccattagctatctggtgctggcagggctgtgcgcctcactgctgggcgatgcgctaaccctgttgccacgtcaacgtctgatgtacgccatcggcgcgtttttcctctcgcacctgctgtacaccatctatttcgccagtcagatgacgctctctttcttctggcctctaccactggtgctgctggttctgggtgcgctgttactggcgattatctggacgcgcctggaagagtaccgttggcctatctgcacgtttatcggcatgacgctggtgatggtgtggctggcaggtgaactgtggttcttccgtccgaccgctccggcgctctctgcgtttgttggcgcttcgttgctgtttatcagtaactttgtctggctggggagccactatcgccgacgcttccgtgcggataacgcgattgctgcggcctgctactttgccggtcacttcctgatcgtccgctcgctgtatctctgataaaacttgactctggagtcgactccagagtgtatccttcggttaatgagaaaaaacttaaccggaggatgccatgtcgactcctgacaatcacggcaagaaagcccctcaatttgctgcgttcaaaccgctaaccacggtacagaacgccaacgactgttgctgcgacggcgcatgttccagcacgccaactctctctgaaaacgtctccggcacccgctatagctggaaagtcagcggcatggactgcgccgcctgtgcgcgcaaggtagaaaatgccgtgcgccagcttgcaggcgtgaatcaggtgcaggtgttgttcgccaccgaaaaactggtggtcgatgccgacaatgacattcgtgcacaagttgaatctgcgctgcaaaaagcaggctattccctgcgcgatgaacaggccgccgaagaaccgcaagcatcacgcctgaaagagaatctgccgctgattacgctaatcgtgatgatggcaatcagctggggtctggagcagttcaatcatccgttcgggcaactggcgtttatcgcgaccacgctggttgggctgtacccgattgctcgtcaggcattacggttgatcaaatccggcagctacttcgccattgaaaccttaatgagcgtagccgctattggtgcactgtttattggcgcaacggctgaagctgcgatggtgttgctgctgtttttgattggtgaacgactggaaggctgggccgccagccgcgcgcgtcagggcgttagcgcgttaatggcgctgaaaccagaaaccgccacgcgcctgcgtaagggtgagcgggaagaggtggcgattaacagcctgcgccctggcgatgtgattgaagtcgccgcaggtgggcgtttgcctgccgacggtaaactgctctcaccgtttgccagttttgatgaaagcgccctgaccggcgaatccattccggtggagcgcgcaacgggcgataaagtccctgctggtgccaccagcgtagaccgtctggtgacgttggaagtgctgtcagaaccgggagccagcgccattgaccggattctgaaactgatcgaagaagccgaagagcgtcgcgctcccattgagcggtttatcgaccgtttcagccgtatctatacgcccgcgattatggccgtcgctctgctggtgacgctggtgccaccgctgctgtttgccgccagctggcaggagtggatttataaagggctgacgctgctgctgattggctgcccgtgtgcgttagttatctcaacgcctgcggcgattacctccgggctggcggcggcagcgcgtcgtggggcgttgattaaaggcggagcggcgctggaacagctgggtcgtgttactcaggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcgcaagccatcgtacgcgaagcacaggttgctgaactcgccattcccaccgccgaatcacagcgggcgctggtcgggtctggcattgaagcgcaggttaacggtgagcgcgtattgatttgcgctgccgggaaacatcccgctgatgcatttactggtttaattaacgaactggaaagcgccgggcaaacggtagtgctggtagtacgtaacgatgacgtgcttggtgtcattgcgttacaggataccctgcgcgccgatgctgcaactgccatcagtgaactgaacgcgctgggcgtcaaaggggtgatcctcaccggcgataatccacgcgcagcggcggcaattgccggggagctggggctggagtttaaagcgggcctgttgccggaagataaagtcaaagcggtgaccgagctgaatcaacatgcgccgctggcgatggtcggtgacggtattaacgacgcgccagcgatgaaagctgccgccatcgggattgcaatgggtagcggcacagacgtggcgctggaaaccgccgacgcagcattaacccataaccacctgcgcggcctggtgcaaatgattgaactggcacgcgccactcacgccaatatccgccagaacatcactattgcgctggggctgaaagggatcttcctcgtcaccacgctgttagggatgaccgggttgtggctggcagtgctggcagatacgggggcgacggtgctggtgacagcgaatgcgttaagattgttgcgcaggagataaggcaaaccgatcgcaacattgagcgcgatcggtcccctcgcccctctggggagagggttagggtgaggggaaaaggcggcatcgaagccaatcagcccctatcaaccgcctttacgaatcaaataacgataaggcagtccatccgtctctttagcaaccagttcgtgttccataaaggtacaaaacccaggaatatcgcgggtagtggccggatcgtcggcgataatcagcaacgtttcgccaggctgcatattgcgcacggttttgcgcaccatcatcaccggttccgggcagcgcaggccaagcgcgtcgagtgtgtggtcagggctggaaaagagatcggtcattttcttctcatcacttaaaaaaacggcgctagtttacgccctgtgagtccgtaagcaaactaggttaacgattgcgtgaaaattaaccattgcattgtcaacgtaaagcagtatcatgcggcggctcgaaaaaagggtaagcacgttattatgttaaggtaacagacgtgtcgtacgtattgggttccctcaccccaatggttaatcaaaaaggtacaatatgaacgttttctcgcaaactcaacgctataaggcgttgttctggttatcgttatttcatctgctggtgatcacctccagtaactatctggttcagcttcccgtctccattttgggtttccataccacctggggcgcgtttagctttccgtttatttttcttgctaccgacctgaccgtgcgtatttttggcgcaccgctggcccgacgcattatcttcgcggtaatgatccctgcgttattaatctcctacgtcatctcgtcgctattctatatgggttcctggcagggattcggcgcactcgcccacttcaacctgtttgtcgcccgtatcgccaccgccagtttcatggcctacgcgctggggcaaatcctcgacgtgcacgtttttaaccgcctgcgtcagagtcgccgctggtggctggcaccgacagcgtccacactgttcggtaacgtcagcgacacgctggcctttttcttcattgccttctggcgtagcccggatgcctttatggctgaacactggatggaaatcgcgctggtcgattactgtttcaaagtgttaatcagtatcgttttcttcctgccaatgtatggcgtattactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcggaaagtaacgctaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagtattatctccgcgaaaggccagacggcgtactcttccgttattctgggtaacgtgggtaatcaactgctgaccatgcaaattacgctgcccgctgacgatcagcaaaaagcgcagaccaccgcagaaaacatcattaatacgctggttattcagtaagttttaagatgatgaggcggcctcagggacgtgttccggaggccgtttttttaatcgccacgtcagtaataacgcgattgcgaccagtcccgccgccgccagataaatcaccggtacgcccgcccagctcatcaccagcccagccagtggtccagtcacgccaagcgataaatccataaatacggtgtaagttgccagcgccgccccctgattttgctgcggaaccgcttttaccgccactacacccaatgccgggaacaccagcgaaaacccggcccccgccagtaagacgccgattttcgccatccacggcatagtcgccacgccaaccagtagcaggccgattatctcaacgctaaagcaaatcatcgctacgtttaagccaccgatacggttaatgccgttagggaataacaaacgcgtaccgacaaacgcacagctaaacagcgtcagcgcgaaagccgcaccgtcccaacctttagcgtcataaaacagcgtgataaaggtggcgatgacgccaaatccggcggaagccagtgccagcgccataccgtacagccagacgcgcccaagcaccgcgcgaaacggcagcggtttgcctttactggcttttaccgtcggacgcgggatcgccaacaaaatggccaccagcgccacgcccataatgattaacgctaacgcctgcaagccgccccagtgataaaacacgacgcctaacggcgcacccatcgccatcgccccgtaagtgacaatgccgttccacgaaatcacccgcccgatatgcagcgagccaaccacgccaacgccccatagggtcgatcccgttccggcaaaactttgcccaatcccaaggatgacgcgccccaggcaaagtaataacaggctgatgacaggcagactggcggttaatcctgccgtcagataccccagaccgctcaaaaagcagccgcataaaccgaagacgacaatctttttgggtcccagcgaatcggcgtaacgtccggcatgagggcggctcagcaaggtggcgaaatattgcaggctgataaccaatcctgcccagaaggcgctaaagcccatcacatcatggacatagcccggtaatacagcgagcggcaacccgatggtgaggtagctggcgaagttaaacatgactatagagacaatgcgcaaattcaggcgcaatccgtttagcgcgggttcggctacgggttcgggcatgaggatcaccacatttttacaacagtgtttcatttttaccacgtgctgacgtgaaaatcagcagtaagaatcagaatattgctggcgtgactcccgctacacttaatacaaaaagtcacaaggaagccccaatggaaacccctcaacccgataaaacgggcatgcacattctgctcaagctggcctcgctggtagtgatcctcgcgggcattcacgcagcggcagatatcattgtgcagctgttactggcgctgttttttgccatcgtcctcaacccgctcgtcacctggtttattcgtcggggagtacaacgccccgttgccattacgattgtagtggtggtgatgctgatcgcactaaccgcgctggtcggcgtactggcggcatcgtttaacgaatttatctctatgctgccgaagtttaataaggagctgacgcgcaaactttttaaattgcaggagatgttgccttttcttaatttgcatatgtcgccggagcgaatgctgcagcggatggactcggaaaaagtggttaccttcaccacagcgctaatgaccgggctttccggggcaatggcgagcgtgcttttgctggtgatgaccgtagtttttatgctgtttgaagtgcgccacgtcccttacaaaatgcgttttgcgctgaataatccacagattcacatcgcgggattacaccgcgcacttaaaggcgtttcgcactatcttgcattgaagacgctactcagtttatggacaggtgtcatcgtctggctggggctggagctgatgggggtgcagtttgcgctgatgtgggcagtactggcgtttttgctcaactacgtgcccaatatcggcgcggtaatttccgccgtaccgccaatgattcaggtgctgctgtttaatggtgtttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggtagcaaactggcgattttactggggccgggcagaccgaaaagtcggttaccgggatgaggcgacaagtgatacgatacgcactttcattttccattaaacgttggccctgatatgtatcggatagttctggggaaagtttcgaccttaagcgcagctccactgccaccgggtttacgcgagcaagcaccgcaaggtccacgacgcgaacgctggctggcggggcgtgcattgctttcgcacacgctttccccgctaccggagatcatctatggcgaacaaggcaaacctgcatttgcgccggaaatgccgctatggttcaacttaagccatagcggtgacgatatcgccctgctgttgagtgatgaaggcgaagtcggctgcgatatcgaagtgattcgcccgcgcgccaactggcgctggctggcgaacgccgtattcagcctcggggaacacgctgagatggacgccgtgcatcctgatcagcaactggaaatgttctggcgcatctggacgcgcaaagaagccatcgttaaacagcgtggcggcagcgcctggcaaatcgtcagcgtagacagcacctatcactcctcgctgtcagtcagccattgtcagcttgaaaatttaagccttgcgatctgcacccctactccctttacgctcaccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgctctccacactccgccgcactctatttgcgctgctggcttgtgcgtcttttatcgtccatgccgctgcaccagatgaaatcaccaccgcctggccggtgaatgtcgggccactaaacccgcacctttacacgcctaaccagatgttcgcccagagcatggtttatgaaccattggtgaaatatcaggcagacggttcggtgatcccgtggctggcaaaaagctggactcattcagaagatggtaaaacctggaccttcaccctgcgtgatgacgtgaaattctccaacggtgaaccgttcgatgccgaggcggcggcagaaaacttccgcgcagtgctcgataaccgtcaacgtcacgcctggctggagctggcaaaccagattgttgatgttaaagcactcagtaaaacagagctgcaaattaccctgaaaagcgcctactatcctttcctgcaagaactggccctgccccgtcctttccgttttatcgctccctcgcagtttaaaaaccatgaaaccatgaacggaattaaagcgccgattggcaccggaccgtggattttgcaggaatcgaaactgaatcagtacgatgtcttcgtccgtaacgaaaactactggggcgaaaagccagcgattaaaaagatcacctttaacgtcatcccggacccgactacccgcgcggtggcgtttgaaactggcgatatcgacctgctgtacggaaacgaagggttattaccgctcgataccttcgcccgctttagccagaatccggcttaccacacccaactgtcacagccgatcgaaaccgtgatgctggcgctcaataccgccaaagcccccaccaacgagctggcagtacgtgaagctcttaattacgcggtaaacaaaaaatcgctgattgataacgcgttgtatggcacccagcaggtcgccgacaccctgtttgccccttctgtgccctacgccaacctcggcctgaaaccgagccagtacgatccgcaaaaagcgaaagcgttgctggaaaaagccggttggacgctgcctgcgggcaaagacatccgcgagaaaaatggtcagccgctgcgcattgaactttcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatatgatccacacgccttcctcagttcaatgcgcgtaccgtcacacgctgacttccaggcacagcaaggattagccgacaaaccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtatcaaaaccggagctgggtaacatcccctacgcgccgatcgccaccgaaattccgttcgaacagattaaaccggtgaaaccttaatgttgcgttacgtattacgccgctttctgctgctgatcccgatggtgctcgccgcctcggtgatcatttttctgatgctgcgcctcggtaccggcgacccggcgctcgattatttgcgtctgtctaacctgccgccgacgccggagatgctggcctctacccgcaccatgctgggactggatcagccgctgtacgtccagtacggcacctggttgtggaaggcgctgcatcttgactttggtatctcattcgccagccaacgcccggtactggacgatatgctgaacttcctgcccgccacgctggaacttgcaggtgcggcgctggtattaattctgctcacttccgtaccgctcggtatctgggcggcgcgccatcgcgaccgtctgccggatttcgccgtacgtttcatcgcgtttcttggcgtgtcgatgcctaacttctggctggcgtttttactggtgatggcgttttcggtgtatctgcaatggctacccgcgatgggttacggcggctggcagcacatcattttgcctgcggtttccattgcctttatgtcgctggcgattaacgcgcgtttactgcgcgccagtatgctggacgtcgccggtcagcgtcacgtcacctgggcgcgtctgcgcggcctgaacgacaaacagaccgaacgtcgccacatcctgcgcaatgcctcgctgccgatgatcaccgccgtggggatgcatatcggcgaactgattggcgggacgatgattatcgaaaacatctttgcctggccgggcgtcgggcgctatgcggtgtcggcgatttttaaccgtgactatccggtgatccagtgctttacgctgatgatggtggtggtttttgtggtctgtaatttgattgtcgatttgctcaacgccgcgctggacccgcgcattcgtcgtcatgaaggagcgcacgcgtgaactttttcctctcttcccgctggtcggtacgcctggcgctgatcattatcgccctgctggcgctgattgcgctcaccagccagtggtggctgccgtatgacccacaggcgattgatttgccgtcgcgcctgctttcgccggatgcgcagcactggctgggcaccgatcacttaggtcgcgatattttctcgcggctgatggcagcgacccgcgtgtcgctcggttcggtaatggcctgcctgctgctggtgctgacattagggctggttattggcggcagcgccgggttgattggcgggcgcgttgatcaggccaccatgcgcgtcgccgatatgtttatgaccttcccgacctcgattctgtcgttctttatggttggcgtgctcggcaccgggctgaccaacgtaattatcgccatcgccctgtcgcactgggcgtggtatgcacgcatggtgcgcagcctggtgatttcactacgccaacgcgagtttgtgctggcgtcacggctttccggtgcgggccatgtgcgggtgtttgtcgatcatctggcaggcgcggtgatcccttcgctgctggtgctggcaacgctggatatcggccatatgatgctgcacgtcgcggggatgtctttccttggcctcggtgtgaccgcgccgaccgccgaatggggcgtgatgattaacgacgcgcgccagtatatctggacccagccgctgcaaatgttctggccggggctggcgctgtttatcagcgtgatggcctttaacctggtgggtgacgcactgcgcgatcatctggaccctcatctggtgacggagcacgcacactaatgccgcaacagattgaactacgtaatatcgcgctacaggccgcgcagccgctggtacacggtgtatcgttaaccctgcaacgcgggcgcgtgctggcgttagtcggcggtagcggcagcgggaaatcattaacctgcgccgcaacgctgggcattttgcccgctggcgttcgccagacggcgggggaaattttagccgatggcaaaccggtttcgccttgcgccctgcgcggcatcaaaattgccaccatcatgcagaacccgcgcagcgcctttaatccactgcacaccatgcacacccacgcgcgggaaacctgcctggcgttagggaaacccgccgatgacgctacgcttaccgctgccatagaagcggtggggctggaaaacgccgcgcgcgtgctgaagctgtacccgttcgagatgagcggcggcatgttgcagcgcatgatgattgcgatggcggtgctgtgtgaatcaccgtttatcatcgccgatgaaccgaccaccgaccttgacgtggtagcacaggcgcgcatcctcgatctgctggaaagcattatgcaaaaacaagcgccgggaatgctgctggtgacccatgatatgggcgttgtggcgcgtctggcggatgacgtggcggtgatgtctgacggtaagattgtcgaacagggcgatgtagaaacgctgtttaacgcccccaaacatacagtgacgcgcagcctggtttccgctcatctcgccctctacggtatggagctggcatcatgactttacttaacatctccggcctttcccatcactatgcgcacggtggatttaacggaaaacatcaacatcaggcggtgctgaataacgtttccctgaccctgaaaagcggcgaaaccgtcgccctgctggggcgcagcggctgcgggaaaagtaccctcgcgcggttgctggtgggtttagaatcgcccgcgcaggggaatattagctggcgtggcgaaccgctggcgaaactcaatcgcgcccagcgtaaagcgttccgccgcgatattcagatggtatttcaggactccatcagcgccgtgaatccgcgcaaaaccgtgcgcgagatcctgcgtgaaccgatgcgccacctgctatcactgaaaaaatccgaacaactggcgcgcgccagcgaaatgctgaaggcggtcgatctcgatgacagcgttctcgacaaacgcccaccgcagttaagcggcggccagctccagcgcgtctgcctggctcgcgcgctggcggtcgaaccgaaactactgattctggatgaagccgtttctaaccttgatctcgtgttacaggcgggtgtcattcgcctgctgaaaaagctacaacaacagtttggcaccgcctgcctgttcatcacccacgacttacgcctggtagaacgcttttgccagcgggtaatggttatggacaacggacaaatcgtcgaaacccaggtggtgggagagaaattaaccttttcctctgacgccggacgtgtgctacaaaacgcggtattacccgcattccccgtgcgccgtcgcaccacagaaaaggtttaacgcaaatgcaacgagtcaccatcacgcttgatgacgatttactggagacgctggacagcctgagccagcgtcgtggttataacaaccgttccgaagctatccgcgacattctgcgtagcgccctggcgcaagaggccacccagcagcacggcacgcaaggtttcgcggtgctgtcgtatgtgtatgaacacgaaaaacgcgacttagccagccgcattgtctccacccagcatcatcaccacgacctctccgtcgccacgctgcatgtgcacatcaaccacgacgactgtctggaaatcgccgtgttgaaaggtgacatgggtgacgtgcagcattttgccgatgacgttatcgcccagcgcggcgtgcggcacgggcatttgcagtgcttgccgaaggaagattgagtctattattgggtcctttggtgaacgatcaacaaagggccactagcacacctgattcctctctaaataccctatccgaaccttctcttttgtaacgttctaaatatattcctaaaaatcttcaattcattgtgaccacaagtttttcttcgctttttcgtatgaagatactgtcattaaaataatagaaaaggattttacgatgagcggaaaaccggcggcgcgtcagggtgacatgacgcagtatggcggtagcattgttcagggttcagccggggtacgtattggtgcccccaccggcgtggcctgttcggtgtgccccggcggagtgacgtccggccatccggtcaatcccctgctcggtgcaaaggtccttcccggtgaaaccgacatcgccctgcccggcccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggttggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgcctggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccacgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcagggcacagacggatgccgcaggcaggacaacagagtacagcccggatgtggtgacgggcctcatcacgcgcataaccacgccggatggcagggcatcggcgttttactataaccaccacaaccagttaacgtcagccaccgggcctgacgggctggaattgcgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctgacgcgcagtatggaatacgatgctgccggacgggtcatccgcctgaccagtgaaaacggcagccacaccaccttccgttacgatgtacttgaccggctgatacaggaaaccggctttgacggccgcacacagcgttatcaccacgacctgaccggcaaacttatccgcagcgaggatgagggtctggtcacccactggcactatgacgaagcagaccgcctcacgcaccgcaccgtgaagggtgaaaccgcagagcggtggcagtatgacgaacgtggctggctgacagacatcagccatatcagcgaagggcaccgggtggcggtgcattacaggtatgatgagaaaggccggctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggttacctggcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattacgacagtcagcaccggctggtgcactacacgcggacacaatatgaagagccgctggtcgaaagtcgctatctttacgacccgctgggccgcagggtggcaaaacgggtgtggcggcgtgaacgggacctgacgggctggatgtcgctgtcacggaaaccgcaagtgacctggtacggctgggacggcgaccggctgaccacgatacagaacgacaggagccgcatccagacgatttatcagccggggagcttcacgccactcatcagggtcgaaactgccaccggtgagctggcgaaaacgcagcgccgcagcctggcggatgcccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcgctcatcagcacggaaggggcaacagcgtggtgcgcagaatatgatgaatggggcaacctgctgaatgaagagaacccgcatcagctgcagcagcttatccggctgccggggcagcagtatgatgaggagtccggcctgtattacaaccgccaccgctattatgacccgctgcaggggcgatatatcactcaggatccgattggactgaaggggggatggaacctgtatggatatcaattgaatccgatatcagacatcgaccccctgggtttatctatgtgggaggatgcaaaatcgggggcatgtactaatggtctttgcggcacactatccgctatgataggtccagataaatttgattctatagatagcaccgcatatgacgccttaaataaaataaatagccaatctatttgcgaagataaagagttcgctggtttaatatgtaaggataatagtggcagatatttctcaacagcacctaaccgaggagaaagaaaaggatcatatccattcaatagcccttgccctaatggtactgagaaagtatcagcttatcatactcatggtgcagatagtcatggagaatattgggacgaaatattttcaggtaaagatgagaaaatagttaaaagtaaagataacaatatcaagtcattttatttaggtacgcccagtggtaattttaaagcaatagataaccacgggaaggaaataacaaacagaaaaggattacctaatgtctgcagagttcatggtaatatgtaaaaaaatattgtttaggaactgtgtcattgtatctttgtttgtttttacatacaacacatgggcgcagtgtaataataatattaaaataatgcgcaagtatgaaagtgaaggtaaatataccgttagaaatttggttaaaaataaagctatagcattggaattagctgagatatatgttaagaatcgttatggacaggatgccgcagaagaagaaaaaccatacgaaatcactgagttaacaacaagttgggttgttgaaggtaccattcactcagaccaaattgctggtggggtttttattatagaaataggcaaaaatgatgggagaattctgaattttggccacggaaaataagtatgtaaggataatcaaacatcgtgtgcgctgatggcagagtaggtggaggactccagacagtcaaacgatagaaaaagatagcctttatggaggttcctgcaatgtcaaatacataccagaaaagaaaggcaagtaaagagtatggtttatataataaatgtaagaaactaaatgatgatgaattatttcgcttacttgatgatcgcaattccttgaaaaggatttcatctgccagagtattacagttaagaggggggcaagacgctgttagattggcaattgaattctgcactgacaaaaattatatccgtagagatatcggagcatttatactcgggcaaatataaatttgcaaaaaatgcgaagataatgtttttaatattttgaacaatatggcattgaatgataagagtgcttgcgttcgagctacggcaatcgagtcaacggccagggaaagatcatcaaaagttcactttttgcactaaataattcgcattttatgtttaaaaattgagatattccttattacctgaagctgttttttattgcttatacatgatcaaatactccttacctaattaaggagaacaaaatggaacttaaaaaattgatggaacatatttctattatccccgattacagacaaacctggaaagtggaacataaattatcggatattctactgttgactatttgtgccgttatttctggtgcagaaggttgggaagatatagaggattttggggaaacacatctcgattttttgaagcaatatggtgattttgaaaatggtattcctgttcacgataccattgccagagttgtatcctgtatcagtcctgcaaaatttcacgagtgctttattaactggatgcgtgactgccattcttcagatgataaagacgtcattgcaattgatggaaaaacgctccggcactcttatgacaagagtcgccgcaggggagcgattcatgtcattagtgcgttctcaacaatgcacagtctggtcatcggacagatcaagacggatgagaaatctaatgagattacagctatcccagaacttcttaacatgctggatattaaaggaaaaatcatcacaactgatgcgatgggttgccagaaagatattgcagagaagatacaaaaacagggaggtgattatttattcgcggtaaaaggaacccaggggcggctaaataaagcctttgaggaaaaatttccgctgaaagaattaaataatccagagcatgacagttacgcaatcagtgaaaagagtcacggcagagaagaaatccgtcttcatattgtttgcgatgtccctgatgaacttattgatttcacgtttgaatggaaagggctgaagaaattatgcgtggcagtctcctttcggtccataatagcagaacaaaagaaagagccagaaatgacggtcagatattatatcagttctgctgatttaaccgctgagaaattcgccacagcgatccgaaatcactggcacgtggagaataagctgcactggcgtctggacgtggtaatgaatgaagacgactgcaaaataagaagaggaaatgcagcagaattattttcagggatacggcacattgctattaatattttgacgaatgataaggtattcaaggcagggttaagacgtaagatgcgaaaagcagccatggacagaaactatctggcgtcagtccttgcggggagcgggctttcgtaatcttgccctgaatacaggactgagtatcaaaaagccggttaactgaaactgtccaggttttgggggtcagttcataaacgccttatccggcctaaaaacaactaaaattcaataaattgcaccgatgcgtagtccctataagcttacgcatcgggcaattgtatttacgccattgtcccaatcgtcttcctgaatcgcagcagcgcaatggtgaaaaatgcgccgccaattgccatcagcgtcagaaactgcggccagacgatttcgaatccggcaccccggtagaggatggcctgcgcgaggctaacaaagtgtgtcgtcggcatggtcagcataatgtcctgcaccatctgcggcatactttcgcgcggcgtggaaccaccggaaagcatttgcagcggcagcagcaccagaatcaccagcagccccagttgcggcattgaacgcgctatcgtccccataaaaatgccgattgacgtggtggcaaacagactgagcgccacgcccagcataaacagcgggatcgagccttcaatcggtacgcccagtacacctttcaccatcagcaccagcgataatcccgataccaccagcaccaccagccccatcgaccagatcttcgccatcatgatctcaaacggcgttatcggcatcaccagtaagtgttccaccgtgccgtgttcacgctcgcggatcagcgccgatccggtcaatacaatcgccagcatggtaatgttgttgatgatcgccatcaccccgccaaaccacgcgggatcgaggttcgggttaaagcgcatccgggtttccagcgataccaacggttcgctgttatcacggtagcgcgcgacaaagctgttcacttcaccgttgataatattctggatatacccattgccggtaaatgcctggctcatgcgcgtggcatcgacgttcacctgaatatccggctggcgtccggcgaggacatcacgctgaaaattaggcggaatatttatcgcgaaggtatagcgtccggcgtccagtccggcatccatctcatcggcggtgatcatctccggtggcaaaaaccacggacgatagaagctgttaacgatccggttcgataactgcgattgatccatatcggcaatggcgatcggcgcgaggttcaacgatcctggcgtaacggtcgctgacgaatacaccgacaccgtaaacgagaagacaatcagcgtcagcatcgctttatcaccgagcagactgcgcaactctttgatacccagattaaaaatattgcgtaaatggcgcatcatccctcctgttttttcagcagcaggatacttaagcccatcaccagcgggatggctatcagtaacgggataaaaagttgccacaaatcagtcagatccagcgctttcgagaacgtcccgcgggcgatagtcagaaaatgactggtcgggtaaacctcgccgatccaacgtccaggcccttccagcgaagctaccggatcgatcatcccggaaaactgtgtcgccgggatcaacgtgataatcgccgttccgaaaatggcggcaatctggcttttcataaaggtggagatcagcagccccattccggtggcaatgatgatatacagcagcgccgccagggtgagcgtcaggaaactgcctttatgcggtacgccaaacacaaacaccgacaggccgcagagcaggaaaaagttcagcatccccagcgcgatgtatggcaactgtttaccaagcaaaaattcactacgcgtggtgggggtcacgtaaaggttgataatcgacccaagctctttttcccgcaccacgctaagggcgcttagcattgacgggatcatcatcagcagaagcgggatcaccgccggaacaatcgctggcaggctttttacgtccgggttatagcgatagcgcgtctcaatattcatcagcccgctttggctggcgggtgtcgattgtcggctcgccacatcctgtaaccagctctggtgcatggcctgcacgtaaccttttaccgtttcagcacggctcggcatcgctccgtcgatccagacgccgagttccacaggcgtaccacgcgcgatatcgcgcccgaaattgggcgggatctcaatcgccaccgtgatatcgcccgcacgcatccgacgatcaagctcgtcataactggtgagcggcggctgttcgataaagtaacgggaaccggagaggttgagtgtccacgcctggctactgacggtctggtcgcggtcgagcaccgcaaagcgcaggttttccacatccatactgatgccgtaacccattatcagcatcaggatcaccgttcccatcagcgccagcgtcgaacgtactggatcgcgtcgcagttccagcgcttcgcggcggctgtagctaaacagacggcgcaggctaaatccctgacgcggcgcgtgggtggtgtcgtgtaccacgggcggcgcttcggcttcgttgctctgccctgccgcttcctgcaaataggcgataaatgcctcttccagactggcggctccgcgtttctcaaccagttcctgcggtgtaccgctggcaagcacttttccggcgtgcatcagtgagatgcggtcgcaacgttccgcttcgttcataaagtgggtggagatgaagatagtcactttgtcctggcgcgagagatcgaccatcaactgccagaacatatccctcgccaccggatcgacaccagaagtaggctcatcgaggattaacatctccgggcgatgaatcaccgccaccgccagcgaaagccgctggcgaatgccgagcggcaatgactccggcagaatatcttcaacgtcgttgagcttaaaacgctcgctcatttcagccactcttgcgggaatttccgcttccgggatgtgaaacaaacgggcatgtaactcaaggttttgccgcacggtgagttcgttatagagcgaaaacgcctgcgacatatagcccacccgacggcgggtatcgatatcttttggatcaaccggttgcccgaacagccacgcctcaccttcgctggcgggcagcagtccggtgagcattttcatggtggtggatttaccgcagccgttcgaaccaagaaaaccaaaaatctccccgcgtggaatgcggaaattaacgtgatcaacggcaacgaaggaaccaaaacgcatggtcagatcgcgcgcttcgatggcaatctctgcgttttcaggttgatacggtgggatcactaccgcctgatgcgcctggcgttgcgcttgcggtaacagatttataaatgcttcttccagcgtagcgctttgcgtttgctgccgtagctcttcggcgctgccagttgccagcacttctccggcattcatcgctaccagccagtcgaagcgttcggcctcttccatataggcggtggcgaccagcacgctcatattgctctgccgctggcgaatactgtcgatcagatcccagaactgggagcgggagagcgggtcaacccccgttgttggctcatcaaggatcaacagttccgggtcgtggattaacgcgcagcacagcccaagtttttgcttcatcccgccggagagtttccctgccggacgatcgcgaaacggtgctaacccggtgctggtcagcagctcattgattcgcacttcccgctccgctttgtcgtgaccgaacaggcgagcgaaaaaatcgacgttttcatacaccgacaaggtgtggtagaggtttttgcccagcccctgcggcatccaggcgatgcgcgggcagacgtcgcggcgatgcttcgggtcgcgcatatcgccgcccagcaccatcacattgccctgttcaatgacgcgggcaccggaaatcaacgacaacaagctcgacttcccgacgccgtccgggccaatcagcccgaccatacagcgggccggaatatcgagagtgatattgttcagcgcaacggtttttccataatgctggctcacgcccgccagttgcgcgacaggcgggacgggaaccagttccagatgcgtcattgcggcaacctcaccacgaggtcgtcaggccacggaagttcttcattcacccgcacccacgctacgcccggcaaaccggttttgacatattccagatgctgctggagtaattccggtgggatacgcgctttgacgcggaacatcagtttcagccgttcatcgctggtttcgacggtttttggcgtgaactgggcgacactggcgacaaaactgatggttgcaggaatacgcagatctggcgcggcatcgaggatcagccgggcttcaccgcccagtttcagcgtgcccgcctgttcggttggcaggaagaaagtcatatagacgtcgctgagatcgaccatattcagcacccgaccgcctgccgccagcacttcgcctggctcggcaacccgatactgcacgcgtccgtcacgcggggctttcagttcgctgtcatcgatatctgcggcaatgcgccgttcagtggcttgtgccgcttcgacgcgggtttgcgcctgaatgatattggtgcgtgccgcttctatagccgctttagaagccgatacctgagctttcgccgattccagcgcagctcgggcgctctcagcggcggcgcgatcgtcatccagctgttgcgcagaaatagcccctcgttgggccagtgaacgggaacgcgtatgacgttttgctacggagtccagttctgcctggcgttgattaaccagcgactgtgcggcacgagtttcgctttgtcgttgctccagcaaagcctgcgcggcagcaacggcgctttgtgcctctttgatttgcgcgatggcttccagtcgctgttcctgcaacacgcgagtatccatcttcgccagcacttcaccttcgcgaacaaacttgccttctttcaccagaatggtgtcgatacgcccggcaattttgctggcaatatccacttccgtcgcttcaatgcgcccattactgacagcaaagccttccggcacacctgccgggcgcaacagccaccacgccacgatagccgccaccgccagtaacccgacaacccaccacgccagatggcgcttactcttatccataatcgacccgccataatccctgtaagcaaacgacgcgtgttacaactgccgccgaacgacgttcagcggattcttccatccgggataagaaggaaacggcaaatacgaccagcgcgcagagcattgagcgccaacggggaaggcttagtgaaaacgggtagtaatgttgtcatcatcagcattcctggccgtaaatgaaacacgcatactcataagtgtgatctataaaactggctgacaaaacggtatccatcctgttggatagcgtttcacgcctgttcagttgcaggaacagagcattcctttttacgttttatcaacagtctcaaccagatagtaacattaatattcatgttgtctatggttcagagctgtaacattgtgcgccttctaatcaaaggcataagtccatttctgtttttttcatgctggtaagacttccagggagtggttatctcaggccctgcaccagggttaatttggcaattatgcatgctgaacattcttccagcatgtttactgtcacgggcgttaagacctaaaactgtccccgtttcgcctatgcgttctcttccaccatttccgttatgtgcaacaacttgatttatacctaacatttgtgaacatgctaatagtgcttcaagtttaggtctgtaatctgtcgaaacagaaaaataacgattaaaggatcgacaagagatagcccggctagttttaaactttttgccattaattatagcatgatgctttttattgataattgccgctaattcgaccggatcgagagcattggtcatttcatcaatagagactgttatcggtcctataatgtaacgttttcgctgatcatcaaaagttatcccatgatgatttgccattattttgtatttggggtcatagaaacatacaggataatcttttatcccagagtaggtatcctcatcgagtggtttcatacgcgtgaagttctgcatatagttaccattgcaattcgtttcatgatttccagctaatacatgaacattttcattgatactcattatgcgttttaacaaatcgatgataaattgatcaccacagatattgctaaatcgatcgccggtttggtcgcccagaaacgtacatggcgtcacagcgtctttattaataactaaataaggctgaagactttctaaaataatgtctcttctgttcaggatactgattattgtattaacattagtgttaagttgctcattaaagttctcccttagcaatacgttgagaacttcatcttctatattaagcaactggctaaggaaattttctccttcagccatgattcccaaatgtcccgttgcgaaaagcgcgaacaaaactgcaccgactgagccatcggtatcaccaaaataggttggtctggtacttgtgggatcaacgggtaaacaattggagaaatagattctgtcagcgaactggggttttatcattgtttcgaatttaatatcagatacattatattgcgatattttccagttccagatgggtttgtacgactcagtaactgcaacatcattagcattatcatttactgtcatattattaagtaaataaacaatactgcaccaattaatatcggtattatcaagagagcaaccgtaatttttgctattaattgtcacaataaactgataattattattcctacgtagaatatgagcacgcatgcccgatagcatactatatttttctgaatgatccgtttgtatggtaaatgaaattttgtcatcttgaatagattgttggaaccgttctatttgccaatcatctattttttccacaacctcaccgagcattgtcctggcaatacttgatatatcatcacctataccatttgcaatatacccaaacagttctttagtgaagttggtaacatgctcttgcaccatatcatttgttgcgattgtcgttgtactgtcgttagtgcctgccacagttccaattttcatattttacctcatattatttaccgcgaggaatacatagttaacattttatcttatgacatacacctcatgttcgatgggaaaataattatattttgcacaaatcattcagcctcaaagcataatatgaaatttcttatctcatagcagagaaagtccctaaagattgtagaggcgtcatcagaacatgcctctacaatcgattaagaaaacctatgaaatactggcaggattaaaaagacataccaccgtattcatggagttttaatgtagttgaaaacaactaagccctgaggaataaattattttattatttttatcacgtgcttccttcagggaatttagccccataataccattatcaaattgttgattatgatctaccccgggcccatgatgcccatatttttgtctaatgtatttgctggggtcttcacctttgagtgtctccccacatatgaagatacgttcacgtgctggtctgaaatcagtagtgttatcaaaataattagcatatacaggtgtgggtttcaaagtattgcttcggattagatggaatagaggatcatccatgtgttctttatgttttttattaaaaatattggctaattcctcaggatcagtaggatttttcatctgattaaatggaacctgcaaagcaccgagacaataacatttttttcttcatctcttattattccgtgatgactggttaaaacttgcctttctgagtcataattacaaacatcgagcgttttaattaagttatacgtatcaccggcagagagtttatgatttgctagtcgtgcagtatagttaccattaaaattgatttcatgatttccagccagaacgacgacatttttattaatacggctatctttattaccctccatatttcgcatagaatttagcaaagtaaggatatatttatcaccaaaaatagtactaaatctatcgcctgtatgatccccaaggaagatacaaggggttatcgcatcgtcctttaaaaaaacatgttgatgcaactcattcaagatcatgtctctcgtatttaataaatcgtagagcactttattatttttatgtttgtatgcagatgaagccatctcttcgtgttttaataattcacataataaactccaacccttttccctgatgcctatatgccctgaaacgagcaatgcataaagtacagcgcctactcttccatctgtatcgccaaaataagccgtgttggcattttgtgggttaatcacaccacactgtttatagaagtctatttttgaaaacacagatttaacatagctatcaaacttttccttagtaaacgtctctttagagacatcccaacgccagtcaggtttgaaattaccactaagaagagtaaagaaatttctcgctatgatagaaagcccatcaactttataaattatatctgatttatctccagaggaattaataaaataataaccgcccttacactcaacagtaacggtaatgggagacgataattttaacacatggttattgtctggtataattgtaaagataaacgtatcagtagtattgtcggcgaatctattatattcttgaatatctatagaaggttcactattataaaaccatactttctccatctggtgactacgatcatttaccttccagtgaccatgttgcaggaaatagatgatatgcaggccaaaatcgttatctatttgcgaatcattatccagtttatcaaattcaactatctttgcacgatgtgttttatcaaccttgccatggtgttgatgactgttaactttatctgaatgcttatcttgatggcttgaagagatgtttctaatctgattgtcaattgctttcataaataacctgtgatatttttgaattgtttgtaacaaaataaatgatacttgtctgaaaaacagatttacgacgatataaaataataatacttatatgttcgctgattttaagcaccgagactatccggtcttttaccaaataatgaagaataatccctccctggaagataattgtaaaaaacaacagcataagaattaatcttaggataaatttttatttatcatggccttttgaacgctgaaaagtagcgctctgcaaagtaaaccccgctatagttatgctatgcatttgtctttaatgatatctcgtcattatattaacaggatgaaattatcattaatgcatatttcaatattagcagggatacctgaggagtttaaagtgaacatatatatcgggtggcttttcaaattaatccctttgattatgggcttaatttgtatcgcgttaggtggctttgtgctggaaagttcagggcaaagcgagtatttcgtcgcgggtcatgtgctgatttctctggcggccatatgcctggcattattcactaccgcatttattatcatttcgcagctcacgcgcggcgttaatacgttttacaatacattgttccccattattggctatgcggggtcaattatcaccatgatatggggttgggcactgttagcaggcaatgatgtgatggcagacgagtttgtcgccggccatgttattttcggcgttggtatgattgccgcctgtgtatcgacggtggcagcgtcatccggtcactttctgctcattcccaaaaatgcagcggggagcaagagcgacggaacaccggtacaggcttattcttcattaatcggtaactgcctcattgccgttcccgttttactcaccctgctcggtttcatttggtctattacgctgttacgtagtgctgacataactccgcattatgtcgcgggtcacgtattgcttgggttaaccgcaatctgtgcctgtctaattggccttgttgccacaattgtccatcaaacacgtaatacgttttcaactaaagaacactggctgtggtgttattgggttatttttctcggctcaatcacggtactgcaggggatatacgtcttagtcagttccgatgcaagcgcccgactggctcccggcattattcttatttgcctcggaatgatctgttacagcatattctcaaaagtctggctactggcactggtatggagacgtacctgttcgttagccaacagaataccgatgattcccgtcttcacctgcctgttttgccttttcctggcatcgtttcttgcggaaatggcgcagaccgacatgggatattttattccttcgcgagttctggtcggtttgggagcggtatgctttacgttgttctcaatcgtttcaatattagaagcgggttctgctaaaaaataattgcaacgtaccggataaaaccagcgttgaccatttgcgtaacgctggtttttcttaggcatcatgaaataacgcagcattaatgcatagtggttaagtataaaaaacagcaaagttactgtttttttcaacctgttcatatttcataaagatctggccactgagtgagttttcaatcacctttccatccaccttatattaagcatggagggtttcagttcacgggctcattagaaaataatcacaagataaccactatcaaaattagctcatttttaatgcgactctaataattttcatctttaggaaataggtcaggacgactttgctgcaatcaaatcctgcgcacaagcccacgcactcgaccacgcccactggaagttatagccccccagccagccggtgacgtccatcacttcgccgatgaagtacagcccaggcactttgcgcgcttccatcgtccgtgaagagagttcgttggtgtccacgccgccgagcgtcacttcggcagtgcgatagccttcagtgccgttgggttgtacgcgccagtcggtcaatgtgctaatcagtgcctgttggtcacgcacgttgagctgttttagcgaaacatccgggatttgcccgagttgctgtaagcgttcaaccaaccgcttcggtagatgaaccgccagtgtgtttttcaggctttgattcggatgtgcgttacgctgctcattcaggaaggtttcgaggtccacatccggtagcagattgatgctgacaaattcccccggttgccagtagcttgaaatctgcaacaccgccggtccagacaagccgcggtgggtgaagagtaagttctcacggaaaacggtgccgttttcagcggtaatcacggaaggcaccgccacgcccgccagcacctgtaactcttcgagcaacggtttatgcagagtgaatggcaccagacccgcgcgggtcggcagcacgttgaggccaaattgttcggcaatcttataaccaaacggcgacgcgcccagccccggcattgacagcccaccagtcgcgatgaccagcttttcgcaaccgacagtcatgccgttcagatcaagcgtgaagcctgtttcatccttcgccacactcagcacttcgctacgcaatctgaaggtcacattgcccttctcgcactcatccaccagcatgtcgacaatctgctgcgcggagtcatcgcagaagagttgccctaacgttttctcgtgccaggcgatgccgtgtttattgaccagatcaatgaaatcccactgggtaaaacgtgcgagtgcagacttacaaaaatgcggattctggctcagataagcgcctggttcgacataaaggttggtaaagttgcagcgcccaccgccagacataaggattttgcgccctggttttttaccattatcgatcagcagaacccggcgtcctgcctgacctgccagcgcagaacagaacatacccgccgcaccagcgcctataataatggcatcaaacctttccacgttgcgctcctcttagaaaaaacgggcgtgaattgtaaagattcctcagtggtcgcaccagcatcaatattactaaaaggaagtatttgcctgaattatataagataattattttttgagtgaaatccatacagggggcaaatcaaaaaaagtctatatttcactttgcccgcgccgcgaaagtcactgataatgcgccgcgttcatgtcctcaaaatggcgtaacgtcctatgctacatttgtttgctggcctggatttgcataccgggctgttattattgcttgcactggcttttgtgctgttctacgaagccatcaatggtttccatgacacagccaacgccgtggcaaccgttatctatacccgcgcgatgcgttctcagctcgccgtggttatggcggcggtattcaactttttgggtgttttgctgggtggtctgagtgttgcctatgccattgtgcatatgctgccgacggatctgctgcttaatatgggatcgtctcatggccttgccatggtgttctctatgttgctggcggcgattatctggaacctgggtacctggtactttggtttacctgcatccagctctcatacgctgattggcgcgatcatcgggattggtttaaccaatgcgttgatgaccgggacgtcagtggtggatgcactcaatatcccgaaagtattaagtattttcggttctctgatcgtttcccctattgtcggcctggtgtttgctggcggtctgattttcttgctgcgtcgctactggagcggcaccaagaaacgcgcccgtatccacctgaccccagcggagcgtgaaaagaaagacggcaagaaaaagccgccgttctggacgcgtattgcgctgatcctttccgctatcggcgtggcgttttcgcacggcgcgaacgatggtcagaaaggcattggtctggttatgttggtattgattggcgtcgcgccagcaggcttcgtggtgaacatgaatgccactggctacgaaatcacccgtacccgtgatgccatcaacaacgtcgaagcttactttgagcagcatcctgcgctgctcaaacaggctaccggtgctgatcagttagtaccggctccggaagctggcgcaacgcaacctgcggagttccactgccatccgtcgaataccattaacgcgctcaaccgcctgaaaggtatgttgaccaccgatgtggaaagctacgacaagctgtcgcttgatcaacgtagccagatgcgccgcattatgctgtgcgtttctgacactatcgacaaagtggtgaagatgcctggcgtgagtgctgacgatcagcgcctgttgaagaaactgaagtccgacatgcttagcaccatcgagtatgcaccggtgtggatcatcatggcggtcgcgctggcgttaggtatcggtacgatgattggctggcgccgtgtggcaacgactatcggtgagaaaatcggtaagaaaggcatgacctacgctcaggggatgtctgcccagatgacggcggcagtgtctatcggcctggcgagttataccgggatgccggtttccactactcacgtactctcctcttctgtcgcggggacgatggtggtagatggtggcggcttacagcgtaaaaccgtgaccagcattctgatggcctgggtgtttacccttccggctgcggtactgctttccggcgggctgtactggctctccttgcagttcctgtaatcgtacgcaccaaaacgagcgggtcagctggcccgcttcagattgtgacatagtgcgctttgttcatgccggatgcggcgtgaacgccttatccggcctacaaaaacatgcaaattcaatagattgcagagattatgtaggcctgataagcgtagcgcatcaggcaattttgcgtttgtaatcagtctcgagcgggtcagtttactggcccgctttttttatgcgttattattgctgaagtgcttaatgccaaatcatcaatgcaatcaggctgaccaccaccagaccacacaatgcgctggtcagaataaactgccgacgcacccgctcacagcggcgaataaattcatcatcgtgatgatcgcgataacgttgggcatagatataccaaacgagacgcacctgtttgttgggttggccatgtgaggtaaaaaagccccctccatcaacatattgatagagcaatggatcgcagttacgcagtaccactaacaacgcgcgtagtgatgagaaatagcgcgccatgttaacaatgcaaacgacacataaagcccaaaataatgcgacggtgcttatcatacctcctccccggcgacctgcccgcggagttccaccccggggctaccgctcccgatacgctgccaatcagttaacaccaggtcctggagaaaccgcttttgtggtgaccaacatacgagcggctctatagatagtgtaggagatcaggttgttttttttccagaaggttaaccactatcaatatattcatgtcgaaaatttgtttatctaacgagtaagcaaggcggattgacggatcatccgggtcgctataaggtaaggatggtcttaacactgaatctttacggctgggttagccccgcgcacgtagttcgcaggacgcgggtgacgtaacggcacaagaaacgctagctggccagtcatcgacaactttatggaaggagtaacactatggcttataaacacattctcatcgcggtcgacctctccccggaaagcaaagttctggtagagaaagcagtctctatggctcgcccctacaatgcgaaagtttctctgatccacgtagatgtaaactactctgacctatacaccgggcttattgatgtgaatctgggtgatatgcagaaacgcatctctgaagagacacatcatgcactgaccgagctttccactaatgcaggctacccaatcactgaaaccctgagcggcagcggcgacctgggccaggttctggtcgatgcaatcaagaaatacgatatggatttggtggtttgtggtcaccaccaggacttctggagcaaactgatgtcttccgcacgtcagctgatcaacaccgttcacgttgatatgctgattgttccgctgcgcgacgaagaagaataatcttccctctacgacgtgttcctgaacgcccgcatatgcgggcgttttgctttttggcgcgccttgttacctgatcagcgtaaacaccttatctggcctacggtctgcgtacgcaatcaaaatccccagccaatacaacatttaacaccatcatattttccatcattagtgtgatcatctggttattttctgttgtaatagtgtattaatctattcaccgcatcaatattaagaatctctgacagatgtaaactttttcgcgcgttatcccttacgcgttcatacttttcaggatggtattggaaggttaataaatatgaatacaacaacacccatggggatgctgcagcaacctcgcccatttttcatgatcttttttgtcgagttatgggagcgattcggctactacggcgtgcagggcgtactggcggttttcttcgttaaacagcttggattctcgcaagagcaggcttttgtcacttttggtgcttttgctgcgctggtctatggcctcatttccattggcggctatgtcggcgaccacctgctggggaccaaacgcaccattgttcttggagcacttgtgctggcgattggctacttcatgaccggcatgtcgctacttaagcctgacctgattttcatcgccctggggactatcgctgtcggtaacggcctgtttaaagctaacccagccagcttgctttcgaagtgctatccgccgaaagatccgcggcttgatggcgcattcaccctgttctatatgtcgatcaacatcggctcgttgatagcgttatcgctggcccctgtgatcgctgatagattcggttattcagtcacctacaacctgtgcggggcggggttaattatcgcattactggtttacatcgcctgtcgtggaatggtgaaagacattggttctgaacccgacttccggccaatgagcttcagcaaactgttgtacgtgttacttggcagcgtggtgatgatcttcgtatgcgcatggctgatgcacaacgtagaagtcgccaatctggtgctgattgttctctccatcgtcgtcaccatcatcttctttcgtcaggcattcaagctggataaaaccgggcgcaataaaatgtttgtcgcctttgtcctgatgctcgaagcggtggtgttttacattctctacgcccagatgccaacatcgctgaacttctttgccatcaacaacgtgcatcatgaaattctcggtttttccatcaacccggtcagcttccaggcgcttaacccgttctgggtggtactcgccagcccaatactggcaggcatttacacgcatctgggtaacaaaggcaaagacctctcgatgccgatgaaatttactctcggcatgtttatgtgctcactgggctttttgacggcggcagctgcgggaatgtggtttgcggatgcacaagggctgacatcgccatggtttatcgtgctggtgtacttattccagagcttaggtgaactgtttattagcgcccttggcctggcgatgattgctgccctggtgccgcagcatttgatgggctttattctcgggatgtggttcctgacgcaggctgccgcgttcttgctgggcggctatgtggcaacatttaccgcggtgccggacaacattaccgatccgcttgagacgttgcccgtctataccaacgtgtttggtaagattggtctggtcacgctgggcgttgcagtagtgatgctgttgatggtgccgtggctgaaacgcatgattgcgacgccggaaagccattaattattcttgcagaaagcagggtagcgttatcgctaccctgttttagttttacactggcgtacctgcatagatatcaaagcgatgccctttagtgactaccgcgtttggcgtggcgacattcgccagcggtggcgcgtagtccgggcgctttaccaccacgcgtttggtcgccagcaagcgtgcaggctccagtaatccatcggcatcaagatccggtcccaccagcgactgaaagacacgcatctcttttttcactagcgcgcttttctgcttatgcgggaacatcgggtcgagataaaccacctgcgggcgcggggtaatatcagtcagcgccgtcaggctggaggcgtgaattaactgcaaccgctcctgcaaccagccgccgatttccgcatccgcataaccacgcgccaggccgtcgtcgagtagcgcggcaaccactggattacgctccagcatccgcacgcggcagccgactgaagccagtacaaaggcatcgcgcccaagtcctgcagtggcatccaccacatccggcaaataatcgcctttaatgcccaccgctttcgccaccgcctcaccgcgaccaccgccgaatttgcgtcggtgcgccatcgctccgccaacaaaatcaacaaagatgccgccaagttttggctcatcacgcttgcgcaattccagatgttccggcgttaacaccagcgccatcaggttgtcttcatcgtgctccagcccccagcgggccgccagaacagataaggcaccgtctccggtgcctgtttcatcaattaagcagattttcactgaatgatcagcccttaatgccgtaatgctccagcatcgcatccagctgcggttcacgaccacggaagcgtttgaacagatccatcggctcttctgaaccgccacggctcagaatgttgtcgaggaacgactgcccggtttcacggttgaaaatgccctcttcctcaaagcgcgagaaagcatctgccgccagtacgtcagcccacaggtagctgtagtaacctgcggcataaccaccggcgaaaatatggctgaaagcgtgcgggaaacggccccaggacggagatggcaccacggcaaccagtttcttgatttctgccagagtttcgaggatttttgccccctgatccgggcggaactcggcatgaaggcggaaatcaaacaggccgaactccagctgacgcagaataaacagcgccgcctggtagttcttcgccgccagcattttatccagcaactctttcggcagcggttcgccggtttcatagtgaccagagataaacgccagcgcctccggctcccagcaccagttttccataaactgactcggcagttcgaccgcatcccacggcacaccgctgataccggaaacaccagcggtttcgatgcgggtcagcatatggtgcaggccgtgaccgaactcgtggaagagggtgatcacttcgtcgtgagtgaacagcgccggtttaccatttaccgggcggttgaagttacaagtcaaatacgcgaccggtttttgcaaagaaccatcagctttacgcatctggcctacgcagtcatccatccacgccccgccgcgcttgttttcacgggcatacagatcgaggtagaagctaccgcgcagttcgttattttcgtcatacagttcgaagaaacgtacatccggatgccagacatcaacatctttacgctctttagcggtgatgccgtaaatacgcttaaccacttcaaacaggccgttaaccgctttgttttccgggaagtacggacgcagctgttcgtcactgatgctgtagaggtgctgtttttgtttttcgctgtagtaagcgatatcccacggctgcaactcatcgacgccaaattcggctttggcaaaggcacgcaattgcgccagctctttttcgccttgtggacgcgcgcgttttgccagatcggttaagaaatccagcacctgctgcgggttttctgccattttagtggcaagggatttaaaggcgtagttttcaaagcccagcagttgcgccagttcgtgacgcagcgcgaggatctcttccatcaccttgctgttatcccatttaccggcgtttgggccttgatcggaggcgcgggtgctgtaagcgcgatacatctcttcacgcagagcctggttgtcgcagtaggtcattaccggcaagtagcttgggatatccagcgtcagcaaataaccttccagctctttcgcttcggcctgggcttttgccgcagccagcgcgctttctggcatccccgccagctccgcttcgtcggtaacgagtttggtccagcccattgtcgcatcgaggacgttgttgctgtactggttgcccagttcagaaagacgggtcgcaatttcgccgtaacgctgctgtttctctttcggcagacctatgccagagagttcaaagtcgcgcagtgcgttatcaaccgctttcttctgcgccgtgttcagcgtggcgtaatgatcgccatcgcgcaggtcgcgatacgctttatacagcccttcatgttgccctacccaggtgctgtattccgacagcagcggcagggtttgttcgtaggcttcacgcagttccgggctatttttcaccgagttcaggtggctgaccggggagaagatacgccccaacacatcgtccacttccgccagcggctggcagagattttcccaggtgtacggtgccccttgcgctactacgcgctccacgttttcgcggcagtcgttcaatgccttagtcacggctggaacgacatgttccgggagaattttagaaaacggaggcaattcaaagggagtcagtaacggattcgtcattcgcgcagtcctggttaaagaggttaaggaagcgctcaacaggcgctttacataatgtgtgtagcatggggttaagtgtagtgaatttcaatgagaaacgttacgctttcgcggcggcggcctcttttcggtatactgtcctgatacgcttttgtgcgccccgaatacgggccgatttttacttaccggaacacctttacccatgctcagttatcgccacagctttcacgctggcaaccacgccgacgtccttaaacataccgttcagagcctgatcatcgagtcgctgaaagagaaagataaaccgtttctctatctcgacacccacgcaggggccgggcgttatcagttaggcagcgaacatgccgagcgtaccggcgaatatctcgaaggcatcgcccgtatctggcagcaggacgatttgcccgcagaactggaggcgtacatcaatgtggtaaaacacttcaaccgtagcggtcagttgcgttactaccccggttcgccgttgattgctcgcctgctactgcgtgaacaggacagcctgcaactgaccgaactgcacccgagcgattacccgttgttgcgttctgaatttcagaaagatagccgtgcgcgtgtcgaaaaagccgacggtttccagcagcttaaggccaaactgccgccggtttcccgccgtggtttaatccttatcgacccgccgtatgaaatgaaaactgactatcaagcggtggtcagcgggatagcagaaggttacaaacgtttcgccactggtatttacgcactgtggtatccggtggtgctgcgtcagcaaattaagcgcatgatccacgatctggaagcgaccggtattcgcaaaattctgcaaattgaactggcggtactgccagacagcgatcgccgtggcatgaccgcttccggcatgattgtgattaacccgccgtggaaactggaacaacagatgaataacgtgctgccgtggctgcacagcaaactggttccggcaggcaccgggcacgccaccgtaagctggatcgtgccggagtaattgcagccattgctggcacctattacgtctcgcgctacaatcgcggtaatcaacgataaggacactttgtcatgactaaacactatgattacatcgccatcggcggcggcagcggcggtatcgcctccatcaaccgcgcggctatgtacggccagaaatgtgcgctgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgaaaacgtgctcggtaaaaataacgttgatgtaatcaaaggctttgcccgcttcgttgatgccaaaacgctggaggtaaacggcgaaaccatcacggccgatcatattctgatcgccacaggcggtcgtccgagccacccggatattccgggcgtggaatacggtattgattctgatggcttcttcgcccttcctgctttgccagagcgcgtggcggttgttggcgcgggttacatcgccgttgagctggcgggcgtgattaacggcctcggcgcgaaaacgcatctgtttgtgcgtaaacatgcgccgctgcgcagcttcgacccgatgatttccgaaacgctggtcgaagtgatgaacgccgaaggcccgcagctgcacaccaacgccatcccgaaagcggtagtgaaaaataccgatggtagcctgacgctggagctggaagatggtcgcagtgaaacggtggattgcctgatttgggcgattggtcgcgagcctgccaatgacaacatcaacctggaagccgctggcgttaaaactaacgaaaaaggctatatcgtcgtcgataaatatcaaaacaccaatattgaaggtatttacgcggtgggcgataacacgggtgcagtggagctgacaccggtggcagttgcagcgggtcgccgtctctctgaacgcctgtttaataacaagccggatgagcatctggattacagcaacattccgaccgtggtcttcagccatccgccgattggtactgttggtttaacggaaccgcaggcgcgcgagcagtatggcgacgatcaggtgaaagtgtataaatcctctttcaccgcgatgtataccgccgtcaccactcaccgccagccgtgccgcatgaagctggtgtgcgttggatcggaagagaagattgtcggtattcacggcattggctttggtatggacgaaatgttgcagggcttcgcggtggcgctgaagatgggggcaaccaaaaaagacttcgacaataccgtcgccattcacccaacggcggcagaagagttcgtgacaatgcgttaaatgttaaagggctaagagtagtgtgctcttagcccttaattacgtttccgctatcagttcagaagctgaagcagaaagcggatcagttccagcagcgcaattaacgcccctagaacgatgattgctttatcaatcacccgttttctccatgcgatggagtgagaatgcatccgcttactcatccactgcctgtcacggcgcatgtctcattgttagataagaactctctcactccggccagagcatcagttaacggcaccacccgtacttctgaccaggactttgaaagcgtttatgcgcattgccagagtgaaaatgcctcagagctaactggataatcatacagtacatgcaggttataaaaccagcacgtccttgcaatagtttcagtatggtattagcattgatgcgttagatgatggctatctcactccagtcagagccaccaactcagggctggaaagtaaaaaaccgacgcaaagtcggtttttttacatccggattcggacaaggcttaatatgacgatgacccagtgaaagtatataaatcgtcactgcgatatataccgaagtgctccctccgccagctgaagaaatcgctaattcttgcaatgttagccactggctaatagtattgagctgttagataagaactctctcactccagccagagccaccaactcagggctggaaagtaaaaaaccgacgcaaagtcggtttttttacgtcctgattcagacctcctttcaaatgaatagccaactcaaaattcacacctattaccttcctctgcacttacacattcgttaagtcatatatgtttttgacttatccgcttcgaagagagacactacctgcaacaatcaggagcgcaatatgtcatttctgttacccatccaattgttcaaaattcttgctgatgaaacccgtctgggcatcgttttactgctcagcgaactgggagagttatgcgtctgcgatctctgcactgctctcgaccagtcgcagcccaagatctcccgccacctggcattgctgcgtgaaagcgggctattgctggaccgcaagcaaggtaagtgggttcattaccgcttatcaccgcatattccagcatgggcggcgaaaattattgatgaggcctggcgatgtgaacaggaaaaggttcaggcgattgtccgcaacctggctcgacaaaactgttccggggacagtaagaacatttgcagttaaaaatttagctaaacacatatgaattttcagatgtgttttatccgggaggcattatgttactggcaggcgctatctttgtcctgaccatcgtattggttatctggcagccgaaaggtttaggcatcggctggagtgcaacgctcggcgcagtactggcgttagttacgggcgtggtccatccgggtgatattccggtggtgtggaatatcgtctggaacgcgacggctgcgtttatcgccgtcattatcatcagcctgctgctggatgagtccggcttttttgaatgggcggcgctgcacgtctcacgctggggtaatggtcgtggtcgcttgctgtttacctggattgtcctgctcggtgctgccgttgccgccctgtttgccaatgatggcgcggcgcttattttgacaccgattgtcatcgccatgctgctggctttagggttcagtaaaggcactacgctggcgttcgtgatggcggccggattcattgccgataccgccagcctgccgcttattgtctccaacctggtgaatatcgtttccgctgatttctttggcctcggctttcgcgaatacgcctcggtgatggtgccggtggatatcgccgcgattgttgccacgctggtgatgttacatctctattttcgcaaagatattccgcagaactacgatatggcgctgctgaaatctcccgcagaagcgatcaaagatcctgctacgttcaaaactggctgggttgttttactgcttctgctggtgggatttttcgtcctggaaccgctcggcattccggtgagcgccattgcagctgtgggcgcgctgatattatttgtcgtcgctaaacgcggtcatgcgattaatacgggtaaagtcctgcgcggtgccccctggcagattgtcatcttctcgctcggcatgtatctggtggtttatggcctgcgcaatgccggattaacggaatatctttctggcgtactcaacgtgctggcggataacggcctgtgggccgcgacgctcggcaccggattcctcaccgccttcctctcttctattatgaacaatatgccgacggtactggttggcgcgttgtccattgatggcagcacggcatctggcgttatcaaagaagcgatggtttatgccaatgtgattggctgcgatttgggaccgaaaattaccccaattggtagcctggctacgctactctggctgcacgtactttcgcagaagaatatgactatcagctggggatattacttccgtacagggattatcatgaccctgcctgtgctgtttgtgacgctggctgcgctggcgctacgtctctctttcactttgtaatgagatactgatatgagcaacattaccatttatcacaacccggcctgcggcacgtcgcgtaatacgctggagatgatccgcaacagcggcacagaaccgactattatccattatctggaaactccgccaacgcgcgatgaactggtcaaactcattgccgatatggggatttccgtacgcgcgctgctgcgtaaaaacgtcgaaccgtatgaggagctgggccttgcggaagataaatttactgacgatcggttaatcgactttatgcttcagcacccgattctgattaatcgcccgattgtggtgacgccgctgggaactcgcctgtgccgcccttcagaagtggtgctggaaattctgccagatgcgcaaaaaggcgcattctccaaggaagatggcgagaaagtggttgatgaagcgggtaagcgcctgaaataaagcggcgatatcccccccacaggttgttagaaaagtgcgctttatttatgtcggatgcgacgctggcgcgtcttatccgacctacaaagttatgaaaattcgatgaatagtatgttatttgtaggcctgacaggcgtagcgcatcaggcgattttgctatttacacagtactccctgcgtgagattccaattatcgcgtccagcatggtgtatcagtgagctgcttagttatcagcgatacagcgcagtagtttaaagacgtactggattatgatttatcagtggtttacacaacaaattattaaataattataagataccttaacccattttattattacacatctaaaacatcacaaaaaaaatcacttcacacactatcagagaacataataactttttaaaatgagcgcattttgatagttgttaacgatttcctttacgatactatcactaccctttttttacacacaaatattaccgggtggagataaaagggaaatcaaaggtaattatatcaggaagatataacgcattacatttattgtgtgtagaagaaaatccattcctgttctaattatccaatttaaacatcttagcataaaacaaatgatgaataaggaattttatgtcaattgactttaccccaggtataataaatacatatcacggcgatatttataactgcacaacaaataccgataatgctaaaacgccagacacaccgaagtggccttgcgataattgggaagaacaacaacccattaattccacattctctggagaaggatatatctctgatcaatatgatttagcgcaacaccaacttcaacaaattaatgcgtgccacacgaacactacatatacaaatgcagactactcaaaagttgtggctcaacttgtaagtcttattactaacattgaaacgataagttcgacacaacttacgcaacagacacaatcaatacttaatcagattaataacattagatatgaaaaaaacaaaagtgctgaatgtcgaatcattgttatcgctaatcctaaacccgacaaggcaatcataactaaaattagcgtagaagagggaatacccataacattcagtgtccaaaccatgttttcagatactaattttattgctgaacaacgagctgacttaccaactaatataaaagatattcaaagcctgtatcaaaaaatgacgaagttatatattgagcacagtgaaaataaaaacaggatgaaagtctttgccggaaccaactttattgatttcaatatgacaggacagaacctgtccgggttcgttctaaccttgtcaaggttttatttcgaagatctacttaatataaatttcactgacgcaaatttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaggtgacactatttttttacataaagaacaccctacccccaaattatataaagatggacaatatcttgacaaacaaatcgaaggtttattttcaacattattaaccattaatgacaaccttttacgagcaaaagcggaaattgcttcgacaataattaaatttttagaggccaggataaccaatctttcatacaatgacatattaaaatatcagcaagaattccaaagacaatgttataagcaagttaaagcctttacgacactctcccgatacaataaaattcaaacatgggcagaaatgtctgaatatcaattcgaagtatttcaatacgagacgcttaacccaaaaaaaatgtcacacacgccttatttaaagaggccactgcctaatgaaaaagatataaattatggggtggaaatagaaataccatctggtaaaagaattcgcttatcaaatcattaccagaatataataccataatattgattattagcactttataatcattgaataaaaatagattttatgtacttttaaaacaatgcactatattatggggtgatggatattcatgtcacgccccaaaattaactgagttcacctaaacagaaaggatataaacatcagacaggtttacgttactatcaggcatatcacctcagaatcagatgaaaactataaagaaatatctattatggttttaatatttgttgataaggatagtaacatgaacatgacaaaaggtgcactcatcctcagcctttcatttttgcttgccgcatgtagttcaattccgcaaaatatcaaaggcaataaccaacctgatattcaaaaaagttttgttgctgttcataaccagccggggttatatgttggtcaacaagcgcgctttggtgggaaggttatcaacgttatcaatggcaaaacggatacgttgttagaaatctctgtattaccgttggatagctatgcgaagcctgatattgaagccaactatcagggccgactgctcgccagacaaagcggcttccttgatccagtgaactatcgtaatcactttgttaccatcctcggcaccattcagggtgaacaacctggctttatcaataaagtcccgtataacttcctggaagtgaatatgcagggcatccaggtgtggcatttgagagaagtggttaataccacctataacctgtgggattacggctatggtgcattctggccggaaccgggctggggtgcgccttactacaccaatgcggtgagtcaggtaacacctgagctggtcaaataacaccaccgaaagatgcagatgctttctcagcatctgcatcatgcattacatcaaattaatacacagtaagctaactattattattataagccctgtcctgttaattacctttggcaaactgattataaagttaatgtccgcaccaggagtcggttatgtttcttataattaccagggatacgatgttcttcaccgcgatgaaaaacattctgagtaaaggtaatgtcgttcatatacagaacgaagaagagatcgacgtaatgttgcatcagaatgccttcgtcattattgatacattaatgaataatgtatttcattctaattttctcactcaaattgaacgattaaaacctgtccatgtcattattttctccccctttaatattaaacgctgcctggggaaagtgccggtgacctttgttccgcggactatcactatcattgattttgtcgcactcatcaatggcagttactgctctgtgcctgaagcggctgtgtcactttcgcgcaagcaacatcaggttctgagctgcattgcgaatcaaatgacaacggaagatattctggagaaactgaaaatatcgctaaaaacgttctactgccataaacacaatatcatgatgatcctcaatcttaagcggatcaatgagctggtacgccatcagcatattgattatctggtgtgaatttcaggcttacggtgagtctggctacgctgccacacagattagctaattgaaacgcctttcacccctgccataccttttaataatcgcaacaggtcttctatcgacgttgtggcatgaagctggatatcaatggcgaccacttcatgatcttcattttcctgcaacgaaactaaatcagtttttattttttgctgcttaaaccagtcgagcattgataccgtattaccgttcactaatgtcagctgtaaatggtaatttttgttcatcaggcggaaggttaattgatggaagacttccagcaccaacaaggtcatcactgaaccataaatacccagttcgtacataccgctgccaataaccatacctatggcggcggtcacccagatatccgctgccgtcgtcagacctacaatattttggttacgaacgagaatgttacctgcaccgataaacccgacgcccgtcaccacctgagcagcaatacggctggggtcgagtccgacgtgatctaaagacagcacgtcagcaaaaccatatttcgaaacaatcataaacagggcgcttcccatgccaattaatacatgtgtgcgtaaccctgctcctttgccgcgcatttgcctttccatgccaatagcgccacaggcaattgccgcgagtataagacgtataataaattctgctgtcatataaaaatgcaaaaaggagcagcaagatggctcaacttgctactcctttttacttgcacctcattaattcggcaagtcattagatgcttgatttttgaaggtatacaaatttttctgcgggtttttcttacagtattcgatcactttaggaatttgagtgagatcggtttcatttaaagtaacggtatcgccacctttatatactgtttcttcatgcagcatccaccatgcaaccggggtcattgcttttggattcagatcaataaattcctggcaggtcatatctttagcggattcattggctgccaacgcagattgtgcgttcaccagtgacaaagccgctacagcgcccataaaaataaacgctttacggagagatgaaatattcattttgtaacccattcaatatagagattatatatgaacaggaggaatagctgcttttaaagaagatattccggcctgttcaatatgcaaggaagtacgatgtaacgcattcccggaattacatatctttcttaattttgtcccattcgcctttaactttatctttaaagttggcttgtttatcctgagtacaagcctgaacgatagctggggttacggttgcaataccctgaacatctaaaaccgcatcttctggtttatctttgttgttcagcgcttcagcaaaaccaactgcagttggctggaaggattcgtccacagccaggaaatcttcacaggtccaggagttgaccggttttttgttatcagctgctttttgcgcatccgctgcattgctcacaactggcagaagaagcagaccaccaagaataacgcctaatacttttttcatcgtaatatcctcaactataaagtgaaagagccgtcacgaatcaatttcgacactgaggttataacctggttttctgtatatgtcatgttgatggaaaatatcaaaatcagatatttttatttcaatacaatgagttacagatgcatcagatactgcaattaggaaatttttattaaatcgactgcattcttagacgcgtttttggcatagattgatagcaggggattttcttcttaattttatagggtggttctatgttatatatagataaggcaacaattttgaagtttgatctggagatgcttaaaaaacatcgcagagcaatccagtttattgccgtgctgctgtttatcgtcgggttgctgtgtatcagtttcccgttcgtctctggcgatattttaagcacagtagtgggtgcattattaatctgctcgggtattgcgcttattgtcgggttattcagcaaccgcagtcataatttctggccggtattatccggtttcctcgtcgcagtcgcctatttattgatcggctatttcttcatccgcgcaccggagctgggcatttttgccattgcggcatttattgccggtttgttctgtgttgcaggggttattcgcctgatgagttggtatcgtcagcgttcaatgaaaggcagctggctacagctcgttattggtgtgctggatatcgtcattgcctggatattccttggtgcaacgccgatggtgtctgtaacgctggtttccacactggtgggaattgaactgatatttagcgccgccagcctgttcagcttcgccagtttgttcgttaagcagcaataattaccccggttgtcacccggatcatagtcacttgatgtgactatgatccgattaatactctctccgctacgcagtgttgtagatcaattgcgcactatcattgaaataattacctgctagtgattatttcaacctactgaatttcatctaatttttttcactctatggcaaattagccatttcaaacattatcatggctgatattttccgtagtcaggtttaatgttttaaaagtgctgtgggaaagtgaacaaagagttccgtaagcgttgatgctatgggcggttaaataagtaatccgggttcatttttttgcaactggcgttgattacattgcataaatatccgtgtctccagacgctatataaaaacctgaagacatgaatgcgttatttactcaggtaatttcaatgcgttaaaagaaagctggcaatccaattgccagcttaagtcgaaacaaggagactcgatatttaaatcggattacattttaactttagtaatattcttcagagatcacaaactggttattgataacttattcttgggcagtaatccgcaaacgttaactttttgtttgctatttacaagctgataacaaccaggaatcttacttaggatcaatatatggagtgcgtgatggataaatctgaagtattgattagtgttaatagacgtattagttcacgaagggtaaagttcttataggcgtttactatattgaacaacgattcggacaaggatgtaaataatgaaaaggatgacatattcgaaacgataacggctaaggagcaagttatgatttttctcatgacgaaagattcttttcttttacagggcttttggcagttgaaagataatcacgaaatgataaaaatcaattccctgtcagagatcaaaaaagtaggcaataaacccttcaaggttatcattgatacctatcacaatcatatccttgatgaagaagcgattaaatttctggagaaattagatgccgagagaattattgttttggcaccttatcacatcagtaaactaaaagctaaagcgcctatttattttgttagccgcaaagaaagtatcaaaaatcttcttgagattacttatggtaaacacttgccccataagaattcacaattatgtttttcacataatcagttcaaaattatgcaactgattctgaaaaataaaaatgaaagcaatatcacgtcgacgctcaatatttcgcaacaaacattaaagattcagaaattcaacattatgtacaagctgaaactaagacgtatgagcgacatcgtcaccctgggtatcacatcttatttttagtcaggacataagcaactgaaattgatggctggcatgacgagggatgcagatgctgatttcattacccccggtgattactaaaggagaggctaaaacgactttattcccctggtatgtgtatccaccagtagaacccttcgttgcccgaatgctggcaggaactgttggcagaacggcaacattttttttgtcgttgacctcaccatgtcgatcactgtgcctgtatcccaccttactggctgacaaccccactatgccgctggtctgtaaatccctcatatctctcctcgcgcgcaatttaaagaaccgttatttctcaagaattttcagggactaaaatgaacagaagaagaaagctgttaataccgttgttattctgcggcgcgatgctcaccgcctgcgatgacaaatcggcggaaaacgccgccgccatgacgcctgaggtcggtgtcgtcacactctcccccggttcggtcaatgtgttgagcgaattgcccggtagaaccgttccttatgaagttgccgagatacgtccccaggtgggcggtattatcattaaacgcaactttatcgaaggcgataaagtgaaccagggcgattcgctgtatcagattgatcctgcacctttacaggccgagctaaactccgccaaaggctcgctggcgaaagcgctctctaccgccagcaatgcccgcatcacctttaaccgccaggcatcgttgctgaagaccaactacgttagccgtcaggattacgacaccgcgcgcacccagttgaatgaagcagaagccaatgtcaccgtcgccaaagcggctgttgaacaggcgacgatcaatctgcaatacgcgaatgtcacctcgccgattacgggcgtcagcgggaaatcgtcggtgaccgtcggcgcactcgttaccgctaatcaggcagattcgctggttaccgtacaacgtctggacccgatttatgtcgatctcacgcagtcggtgcaagatttcttacgcatgaaagaagaggtcgccagtgggcaaatcaaacaggttcagggcagtacgccagtacagctcaatctggaaaatggtaaacgctacagccagaccggcacgctgaaattctccgacccgacagtggatgaaaccacgggctccgtgacgttacgggcgattttccccaacccaaatggtgacttgctgcctggcatgtacgtcacggcattagtggatgaaggtagccgccagaatgtattactggtgccgcaggaaggcgtcacccacaacgcccagggtaaagcaacggcgctcattctggataaagacgatgtcgtgcagctacgcgaaattgaagccagcaaagccatcggcgaccagtgggtcgtcacctctggcttgcaggctggcgatcgggtgatcgtttccggtttgcaacgcattcgtccgggtatcaaagcacgagcaatttcctccagccaggaaaacgccagcaccgaatcgaaacaataacgttgcaggcttaaggggactttcatggctaactattttattgatcgcccggtttttgcctgggtacttgccattattatgatgcttgcaggtggtctggcgatcatgaacttaccggttgcgcagtatccgcagattgcgccaccgaccattaccgtcagcgctacctatccaggtgccgatgcgcaaacggtagaagactcggtcactcaggtgattgagcaaaatatgaatgggcttgatggcctgatgtacatgtcttcaaccagtgatgcggcgggcaatgcctctatcactctgaccttcgagactgggacatctcctgatatcgcacaggttcaagtgcaaaataaactgcaactcgctatgccttcattacctgaagcagtgcagcagcaggggattagcgtcgataagtcgagcagtaatatcctgatggtagcggcgtttatttctgataacggcagcctcaaccagtacgatatcgcggactatgtagcgtctaatatcaaagacccgctaagccgtaccgcgggcgttggtagcgtacaactctttggttccgagtatgccatgcgtatctggctggacccgcaaaaactcaataaatataacctggtaccttccgatgttatttcccagattaaggtgcaaaacaaccagatttccggtggtcaactgggtggcatgccacaggcggcagaccagcagctaaacgcctcgatcattgtgcagacgcgtctgcaaacgccggaagaatttggcaaaatcctgttgaaagttcagcaagatggttcgcaagtgctgctgcgtgatgtcgctcgcgtcgaacttggggcggaagattattccaccgtggcacgctataacggcaaacctgctgccgggatcgccatcaaactggctgccggagcaaacgccctggatacctcgcgggcagtcaaagaggaactgaaccgcttatcagcctatttcccggcaagtctgaagacggtttatccttacgacaccacgccgtttatcgaaatttctattcaggaagttttcaaaacactggttgaggctatcatcctagtcttcctggtcatgtatctgtttttgcagaatttccgtgccacaatcatcccgacgattgccgtaccggtggttattctcgggacgtttgcgatcttgtcggcggtcggtttcaccatcaacacgttgactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcggtattgccgttgttctttccgcagtgtttatgccgatggcctttatgagcggtgcaaccggggagatctaccgccagttctccatcacgctgatctcctccatgctgctttcagtatttgtggcaatgagcctgacccctgccctgtgcgccaccattctgaaagccgcgccggaaggcggtcacaaacctaacgccctgttcgcacgcttcaacacgctgtttgaaaaatcaactcaacactataccgatagcacccgctcgctgttgcgttgtaccggtcgctacatggtggtctacctgctgatttgcgccgggatggcggtgctgttcctgcgcacgccgacctctttcttaccagaagaggatcagggggtatttatgaccaccgcgcagttaccttccggtgccaccatggttaacaccacgaaagtgctgcaacaggtgacggattattatctgactaaagagaaagataatgtccagtcggtgtttaccgttggcggctttggcttcagcggtcaggggcaaaacaacggcctggcgtttatcagtctcaagccgtggtctgaacgtgtcggtgaggaaaactcggttaccgcgatcattcagcgggcaatgattgcgttaagcagtatcaataaagccgtcgtcttcccgttcaacttacccgcggtggctgaactgggtaccgcgtcaggttttgatatggaactgctggacaacggtaacctggggcacgaaaaactaacccaggcgcgaaacgagctgttatcactggcagcgcaatcaccgaatcaggtcaccggggtacgcccgaacggcctggaagatacgccgatgttcaaagtgaacgtcaacgctgcgaaagctgaagcgatgggcgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctactcgtctaccgaatggacctatggttcaccgcgactggaacgctacaacggcatcccgtcaatggagattttaggtgaagcggcggccgggaaaagtaccggtgacgccatgaaatttatggcagacctggtcgctaaacttccggcaggcgtcggctactcatggaccggactatcgtatcaggaagcgttatcctcaaatcaggctcctgcgctgtatgcgatttcactggtcgtggtgttcctcgccctcgccgcactctatgagagctggtcaattccgttctcggtgatgttggttgttccgttaggcgtcgttggcgcattactggccaccgatctgcgcggcttaagtaatgacgtctacttccaggttggtttgctgaccaccatcgggctttccgccaaaaacgccatcctgattgtcgaatttgccgttgagatgatgcagaaagaagggaaaacgccgatagaggcaatcatcgaagcggcgcggatgcgtttacgcccaatcctgatgacctctctggcctttattctcggcgtgctgccgctggttatcagtcatggtgccggttctggcgcgcaaaacgcggtaggtaccggcgtgatgggcgggatgtttgccgcaacagtgctggcaatttacttcgttccggtctttttcgttgtagtggaacatctctttgcccgctttaaaaaagcgtaacgtgtaaatgagagtaaggttgaacatgaaggttcagccttactctttcctgctaaccattcaccactcaacaaccagctaaccgtcaggaataccaggcttagtacacagcactgaaagtagaaaccactccagccattcgtcatcaatttgaacaacacaatactgacccacattcccgtaatcgtatgaattgtcagcttaataatcccaaacatgccgagtcttttcctcctgaaaataccgataccgcctggcaaactgcgaaagagaactagccggtagcccggcagaaatcatcagggaagagtttcacatgaagcaggtgtgagatcctgaccaatattcaaatgcgaaatatgtcaggaaaaggtacctggcgaatgttgcgcaaactgatgtggcgttacaccataatattgtcgaaatgtgtttataaagtacgatgtactgctatagccacatttttccgcaatagtatgcagaggaatttgacgtaactcgagtaatcgtctggccatcgacatcctggaggcgagtaatattttactgaaacaggtattttcatcctgcaacttttttttgattagactctcgctggtatacattctttccgcgatatcgcgcagataccaacgtttggcgatatcaaagctaataaggcgttcaacttttcctgaaacagtgctgatgctattgaaaagtaaggggatcagttctttcttatgagaaaacatcgataaacaggaaaggtagagcatattgctcagtatcggtgaatttaccccggattcattgaagctatcaaaaatcgccgtcaccagcggcatggggggtgactggttaattaacaaacggtctttgctgtgtaaccctaaattgcgtggtagctgacgaatattttgtaagtaatggcaaactgtcagctcatcgatatccagtcgtcgcgtatccggtgaacaaaacgcaaaatcgtctgccaaatttttctccagcagcagaatactctcgttatgcagcgatattttttgctgttcatgataaatatcgaatgaacgacgaatgaggatcaccgagcagacatgagtcatgattatcccttatatttcatactgcgattatttcaatttcagtatactaatgaaatgatgccagactgtttcttagcgcaaaaactgccagatttggtaggaccaaaatttatccacaaagtagttttgcataacagttaattgataataagtaaatgcagcacgaatatattttcgcacagcgtatagcttatgtttataaaaaaatggctgatcttatttccagtaaaagttatatttaacttactgagagcacaaagtttcccgtgccaacagggagtgttataacggtttattagtctggagacggcagactatcctcttcccggtcccctatgccgggttttttttatgtctgagtaaaactctataatcttattccttccgcagaacggtcagtgccgtaaaaattcccttgcgcaacaatacttgccgccgagtcacggttcgacaatctctgcgccgatcgctcctgatactctgtgggcgtcatcccataataatttcgaaagacgtaaatgaaatacgacacgctgtgatatccacaggatactgcaactcgcttaattgaaaaaccatgtataacaataagttgcaaagcacgttgcattctacactcagtaagcaactgtgaatatgatgtctcttcttcgcgcaattttttctttaacagacttggactcatcaacagctcgctggcgattcgggctagtgtccactcatgggcgatattattattgataaccgtacaaactcgtgttcgcatgttcggttgtaaaacgttcagaagcagcggtataaagtgctcatcctcaagaaaaacagataacaacgcaaagattaatgctcttttacgtagcatttctgcatagcgaagattcttattctgcgatagttgcgcaacttcctgaaaaacaggaatatctctactacagtgatgaacgagtaatgaagaaacttttttatgtgcatgaagatttaatgcctcctccttgagcatcgggagaaataatgaaagcgtgtcccttgacacgaatacaaaattttcaacacacttatctactcgaatttggcttgcatccgcaaaaaccaggtcaccgccattaaaatagcgatattcaccattaaccatggtgagaatatatttatgtcttgcatacgcaattagacaattcccatgtagtgattgcatagttgacttaatattacataaacatattactgtttattaatgtagcacgccgccctcttaagtcaaattgattgataaataaatttaaacgaagcgggagaacaggatgataatgtgtgatgttctacgggcaggatgactggatttataatacaaaaacgtgtttaagaacacagggaaattaatagtaagcaaataatcccttttcgtgacattaaaggtaatcgctacatttaataaacattcatataacatatatcttatcaacacgatgaatagacagccaatatattattgcgattaataagcaaccgaatgcccagctgtttttttaaaggctgggcattcggtttttacaacgttatgttatcaggtgtgtttaaagctgttctgctgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcgtacagggtgtatcccggatcttcaccatctttcagtttgaagcaaaccgccgggatgccttcgtccgggcgacccgtacagatgaactcatacggccccagtttggcgatttcatccgccagataagcggcaacctggtaagaggcgttctgtactttggtatagccttcacgaccgaggcgcaggaattcatagtactgtgcaattacctgacccgccgggcgggagaagttgatggcaaaagtaccaatttgaccacccaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccaggaagccaccgctggcagcgtcgatgtgcatgtcgatgtcgataccggtgtcggcctggaatttatccagcgcatcgtgcagcggttgtgggaactcatagttaccggtgtaggtcacgccgaaagtcggcaccacgccgatggtgttttcgtcacaggcttcaatcatgcgtttcgggtccataaacaactgaccggggcgcatagggatctcacgcagctccacatcccagtagcgggcgaatttatgccagcagatttgtaccggaccgcacaccaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatatttacgcaacgcaggtcgatggctgcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctgaaatgcgacatcatcgcgcatttcgtgcagcggaaatcgttttgactccgcgatagtagaaatggcctttgcgccaaaacgtgaatcgagtagttctgagcggaaatccgttaacagcttctggtccatttcgaactccttaaatttatttgaaggcaataaaaaagtaggatttatccgcaatggaagcaaggcattacaggcttaatttaaataacaaaatcctaagcagaaaaacgactttttataatataaacatttaacatgataatattaaaaacagactttattatcgtaataaaaatcgcccaaacattgctgttcgggcgatcaaattaattattgtttatcctgcatatacggcgtgtacaccccgttcagactgtgcaggaaagctacgatatcatccacatcctcctgcggcagctctttgcctacctgatagcgcagcatcagtttcaccgccccgtccagcgtcggcacgtcaccgcgatggaagtacggtgccgttaaagcaacgttacgtaaaccgggtactttctgacgcaatttatcacgctcttctttagtcacattcatacgaccaatatccgccgccgtaatttccccaaagttaaagtcttttttcagccccaacggttcaaaggaacgtccgccgagaataataccaccatgacaagttgcacatttattatctttaaataattgatagccttttttctgttgcgccgtcagcgcattttcatctccgcgcaaccatttatcaaatggggaatccggcgtaattaatgttttctcaaattcagcaatggcatcagtaatattttcgccactgaaaccttgcggatagacttcgaggaactgcgttttaagctgcggatctttttccagcttagcaataatttcgtcccaggatttcgacgccatttcaatcgggttcaacggcggtccaccagcctgatcctgcaatgttgccgcacgaccatcccagaactgctcaacgttaaatactgagttaaataccgtcggcgcgttaatcggcccaactgcgccaccaacaccaatcgatgtttttctgccatcgacgccccccgcattcaacgcatggcaatgagcgcatgaaatggtgctatcagccgataaacggggatcgtgatacagcgcaaaacccaacgccactttttgcgcatcggtaggcagtttttgcgggatgggctgcaccggttcattgcgatgttccggagcagtatcattgctggcgtaatattccgcgcgctgttttgcaatccaggccagtatttccgcccgctcttcatcactcaccttacccgcccagtgtagcgcggtataacgcgttggtggcatagtttcatactgcatcacccattcaatcttattcaaatcgctttgcgaaacgggtttatcagccagcagtgccgcacgcacggcctcaaggttaaaagatttatatccaagcttaatgtcgtaatccatcaactgtttcgcgccaggaatataataataggcgggtaattctgccgaaggcgtgtggcaatagtcgcatcctttttcgcggagaaagcctaaaaccttattattttcactgacagcagatgcctgaacatcggcctgtttactgcgtttattatcgtggtaccacacataaccagataaccctaaatagcaaatcgcgacgccagccaggccgatcgcggtaatacgtgagaccattttcattattcttccctcacggtggtgagttattgtgacccagaaaattttccagaatgctgcaaacgtctctgcgagacaaagccatcataaaaaacagggagatacgctttttgataggaatcaatcaattacatgaatataaactatcaataagatagcctgtgcctattacccagatcaggaatggcatatcatgattgcggcgagagcaggattgaatgttctgaaaatgaaaaacaacaccaaatcggtatttttataaattccattgatattagtgcgttatattttttgacaggttaataaacgtgatccaccgcacgctttgtcgcccaccaggcggagcgaatgactacccttaaagaaaagccgataattagcgacgaatttcggaggttggatccttatgctcaatcagaaaattcaaaaccctaatccagacgaactgatgatcgaagtcgatctctgctatgagctggacccgtatgaattaaaactggatgagatgatcgaggcagaaccggaacccgagatgattgaagggctgcctgcctctgatgcgctgacgcctgccgatcgctatctcgaactgttcgagcatgttcagtcggcgaaaattttccccgacagtaaaacctttcccgactgcgcacctaaaatggacccgctggatatcttaatccgctaccgtaaagtgcgccgtcatcgtgattttgacttgcgcaagtttgttgaaaaccacttctggctgccggaggtctactccagcgagtatgtatcggacccgcaaaattccctgaaagagcatatcgaccagctgtggccggtgctaacccgcgaaccacaggatcacattccgtggtcttctctgctggcgctgccgcagtcatatattgtcccgggcggccgttttagcgaaacctactattgggattcctatttcaccatgctggggctggcggaaagtggtcgggaagatttgctgaaatgcatggccgataacttcgcctggatgatcgaaaactacggtcacatccccaacggcaaccgcacctattatttgagccgctcgcaaccaccggtttttgcgctgatggtggagttgtttgaagaagatggtgtacgcggtgcgcgccgctatctcgaccaccttaaaatggaatatgccttctggatggacggtgcagaatcgttaatccctaatcaggcctatcgccatgttgtgcggatgccggacggatcgctgctcaaccgttactgggacgatcgcgacacgccgcgtgacgaatcctggcttgaggacgttgaaaccgcgaaacattctggtcgcccgcccaacgaggtgtaccgcgatttacgcgcgggggcggcctccggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcactgttccgccagaaagccagtgcccgtcgcgatgcggtaaaccgttacctctgggatgatgaaaacggcatctaccgcgattacgactggcgacgcgaacaactggcgctgttttccgctgccgccattgtgccactctatgtcggtatggcgaaccatgaacaggccgatcgtctggcaaacgccgtgcgcagtcggttactgacacctggcgggattctggcaagcgagtacgaaaccggtgaacagtgggataaacccaacggctgggcaccgttacaatggatggcgattcagggatttaaaatgtacggcgatgaccttctgggtgatgaaatcgcgcgaagctggctgaagacggtgaatcagttctatctggaacagcacaaactgatcgaaaaataccatattgccgatggtgttccccgcgaaggcggcggtggcgagtatccgttgcaggatgggtttggctggactaacggtgtggtacgccgtttaattggtttgtacggcgaaccataatatttttacagccagccgctaacttcctgctggctgtaaaattatcctcttcaggaggagatatttaacatcattgccgcctgggtgcgatttttcacttccagacggcgatacagggattccagatgcgcttttaccgttccggtactgatattcagcgctctgccgatctccttatttgattcgcccgccgctaacatggttaaaatctcccgctggcgggcgcttaacgatttgagatctttaatgtccttttccggcgtcgtccgccagtctccaggcagaaacatcatccccatcgccgcactatttaccgccaacgcaaatgtctcgacggttgaatcacgaggcacaatggccagcacattaaaatggataacttcctgtaaccaccgtttattgcaatccgtcgccgtaattaacaccttaacctcaggaaattgcaccacggttttttgcagcaaccagtagcaaaactcaccatcctgatcgccatcgagcataactaaggcttcagggtaactttccagcttttgccataactcgtctgcctgactggccccctgaatactcactcctggaatacgctgctgtaaactgattttcattccatgaataaatattgactgcctgtcaaacatgactatttgcataactgaatctccacctgaatacgttaaaaagacttaagtagtggaagggtattacccgcgagaaaaaataagaattcgccatttggcggtggccattctacagagatgacgtgtagaaaatagttaccgatataaatagttacagctaaacgcctgaaattacatgtcgagggcactatttaaaacaattttgaggatttccttatattggtggttagtacgcatgcaattaaaaatgaaattccgcgaccacaagccaaaataacaaacggcaaggagacaaaaataagcacaaatagccaacacgtcctctgttcactttaaagggaatcgctgaaaaatacgctctgtttaaggggattcacctttctcagaaagctattccgcccttttcctgctgagaaatcgccacattcggcatgacaacattgtgaaacccggcattagatgttagaaaaaacaataaacaatgcgatatgcgcgttactgtttcgctgtgaacaacaatcggtcaaagaaatggataaaattcacgcaatgcagttgttcatcaaagtcgcggagctggaaagtttttcccgcgcagcggatttctttgctttgccaaagggaagtgtttcgcgccagatacaggcactggaacatcaacttggcacccagcttctccagcgcaccacgcgacgggtcaaactcacgccagaaggcatgacctattatcaacgagcaaaagatgtgttgagtaatctcagcgaactggacggtctgtttcaacaggatgccaccagtatcagcggtaaattacgcatcgacatcccgccaggaatcgcgaaaagcctgttactgccgcgcctgtcggaatttctctatctgcatccgggaattgagctggaactgagtagccatgaccgtccggtagatattcttcatgatggttttgattgcgtgatacgcactggcgcgttaccggaagatggcgttatcgcccgtcccctcggcaaactgaccatggtcaactgtgccagtccgcactatctgacgcgctttggttatccgcaaagccccgatgatctgacttcacacgcaatagtgcgttatacaccgcacctgggtgtacatccgttaggttttgaggttgccagcgttaatggcgtccagtggtttaagtctggcggcatgttgacggtaaacagtagcgaaaactatctcaccgccggtcttgccggtctggggattattcagatcccgcgcattgccgtgcgcgaagccctgcgtgccgggcggcttattgaagtattacctggctaccgtgccgagccgctctccctttcgctggtttatccgcagcgtcgggagctttcccggcgtgtaaacctgtttatgcagtggctggctggcgtaatgaaagagtacctggactgaccgactatactttttaagaatgaccacgacagaaggacaaaagagcggatgacgcaggaaaacgagatcaaacgtcccatccaggatctggagcacgagccgattaagccgttggataatagcgagaaaggcagcaaagttagccaggcgctggaaaccgtcaccaccactgccgaaaaagtccaacgccaaccggttattgcgcacctgattcgcgcgacagaacgctttaacgatcggctgggtaaccagtttggtgcggctatcacctatttctcatttttgtcgatgataccaattttgatggtgtcgtttgccgcagggggctttgtgctggcctcccatccgatgttgctacaggatatcttcgacaaaattctgcaaaacatcagcgatccgacgctagccgccacgttgaaaaacaccatcaacaccgccgttcagcagcgtacgactgtagggcttgtcggcctggcggtggcactttattccggcatcaactggatgggtaacctgcgtgaagcgattcgtgcccagtcgcgcgatgtctgggaacgctcgccgcaagatcaggagaagttctgggtaaaatatctgcgagattttatttcgctgattggtttgttgattgcgctgattgtgacgctttcgatcacctcggttgccggttcggcgcagcaaatgattattagcgccctgcacctgaacagcattgagtggctgaaaccgacgtggcgattgattggcctggcgatttccatcttcgccaactatctgcttttcttctggatcttctggcggttgccgcgccaccgtccgcgcaaaaaagccctgattcgcggaacatttctggctgctattggttttgaagtgattaaaatcgtgatgacctacaccctgccatcgttgatgaaatccccctctggcgcagcatttggttccgtgctggggctgatggcatttttctacttcttcgcccgtttgacgctgttttgcgcggcgtggattgccaccgccgaatataaagacgacccgcgaatgccggggaaaacgcagccttaaaataggccggatgcggcgtaaacgccttatccggcatacgattttattcggcctggctccccgtaggccggataagatgcgccagcatcgcatccggctataatgcgcacataacctcttgaaactcgtccccagagcctcttcagccatctatttgggagcaaacaatttcattccaactcataaccccagcatataaatccagttggtaacttttatttaacctgaaaccagttttatccactatttataaaattatgtgaagcatttcatagaagaaaaatcactggcctaaacattatcccctttttgcctgatttttgaccatttccgcgatttgttacacattgaaatatcacttttgctgtgcgtaatatggctattcgttagccaaaaaataagaaaagattatgcaagcaacagccacaacactcgaccacgagcaagaatacacgccgatcaactcgcgtaataaagtccttgtcgcctctctcattggcacagccattgagttcttcgacttttacatttacgccactgcggccgttattgtgtttccgcatatcttcttcccgcagggcgatcctacggcagcaacgctacagtcgctcgccaccttcgccatcgccttcgtcgcgcgccccattggctctgccgtttttggtcattttggcgatcgcgttgggcgtaaagcgacgctggtcgcctcgttgctaacgatggggatttcgaccgtggtgattggtctgctgccgggctatgccacgattggtattttcgccccgctgctgctggcgctggctcgatttggtcagggtctgggcttaggcggtgaatggggcggcgcggcgctgctggcgactgaaaacgccccaccgcgcaaacgtgcactgtatggctcctttccgcagctgggcgcaccgattggcttcttctttgccaatggcactttcttgctgctttcctggctactgaccgacgagcagtttatgagctggggctggcgtgtgccatttatcttctcggcggtgctggtcattatcggcctgtatgttcgcgtgtcgctgcatgagtcgccggtgtttgagaaagtcgctaaagcgaaaaaacaggtgaagatcccgctgggtacgctgctgaccaaacatgttcgcgtaaccgtactgggtacgttcattatgctggcaacctatacgctgttttacatcatgacggtctactctatgacctttagtaccgccgccgcgccagttgggcttggcctgccgcgtaacgaagtgttgtggatgttgatgatggcagttattggttttggcgtgatggtgccagtcgctggattactggctgatgcctttggtcgccgtaaaagcatggtaatcatcaccacgctgatcatcctgttcgcgctgttcgcctttaacccactgctcggttctggcaacccgattctggtttttgccttcctgctgctggggttaagtctgatgggtctgaccttcgggccaatgggtgcgctgttaccagagctgtttccgacagaagtgcgttacaccggagcatcgttctcttacaacgtagcgtcgattctcggggcttccgttgcgccatatatcgcagcctggttgcagactaactacgggctaggtgcggtggggttatatctggcggcgatggctggcttgacgttaatcgccctgctgctgacccatgagacgcgacatcagtcgttgtaataagagtgaaaagcctgatgcgctacgcttatcaggcctgaatttccatacaatatattgaattcgcaaggatttgtaggccggataaggcgttcacgccgcatccggcatgaacaaagcacactttgccaacaatctaaatctgtttaattgccggatgtcagacatccggcaattatcatcacttcttcatctgcgacaaaatcgtccgacactgattagcctccccttcggaaggtgagatcagtgccagtaacgccgccgccggtgttaccagcgttgccagtgccgcagcaacagcaccacgggcaatcagcggtccggctttcaccccagcctgcggatttttaaacgtcccccgcacatacagcggcgaacgcagtgtgataatccgaattcctttactctccggatcaatagtcaaatccagctgttccgaagcaaaacttgccgtgccggtaacattaatcaacgcgttctcagtatcgaaagcaaaaatctgcgggcgcgccacgccgttggcaatattcagattcgccgccgcgcagttcacccgcacctcatcatcaccaaatatcgcaccgacaatgtagttgccgacattcagcccaacaatctccatcaggttgcggctcaccagcccgtcattcatcaacagtttcaggttgccgttactgttgcctaaaagtgccgccaccgagttaccgctaccgcgtagttccgcgtcaccgttcatttcccccagcgtcttctgcatcagttccacatcgggcatcagttctttcagtttcagtcgacgagcctgaatatctgcccgcccctgcatcggctttttatcgccttccagatgaatattcgccgcaatgctgccgcccgccatgccaaatttcagcggttgcaggcgcaggtcagcatttttgaggatgatatgagtagaaagatcgctaatcggcaggctactgccatgctcaatgcgccgccctttgaagcgaacatcggcatccataacgtcccatttatcggtttcgaagcggtcataaggcagcactttgcccgcaggctgaacgcttttttcgcccttcttctgttcagaccgtttcgacttttctgcccctttcccggaatcaacgccaatcaacggtcccaggtccgccagccgcaattgccgcgactcgacatcaccttccagttttggtcgtggctttccggtggtgtagaccagagaaccgtggatatcgctatcaccaattcgcccattaaaaccgcgataatcaaagaccgacgatttttcagtgtcgattttcgctaccagccgaccatccgtttcaaacggcggggtatcgggcagcagaacgcccgtcagttcatagagatcacccagtgaatcgccagaaaatttaagccgtaaatcgacaccgcccatcttcattgggtcattcacgacgccatcaaaagcaacacgggtgttaccagagcggaaatcagcctgtaccggaaacggcgtcccttcgccacgcagcgccagcataccgcctatttttcccgtacccgtgagcggttcaccgttatatcgtccctgcgccttcaggccaaaaacgtaatcgcccaccttttctttatccgctttacctttcgatccagtaacttcgctgaacggcagcggcttgcctaagggatcaacaaaaatctccagatccgctttgcttactttgtcatcaatggcgatccgcccttgatcgaaaagaatattatccagccgaaacgaccatgccgacggctttgcattcgcgtctttgttatcatcgttggcaagattaaacgtccagttattgttcttttcagagaggcgaatcaggcgcgcgtcgggcttttcgagcttgatccacggcagccagaccgttttggtcagcagcgccagcggggccagcgttgcctctacgcgtggcaaatgcaccatcgtgacttcgggaatatccggtggattgccaagaatgatgtcttccgcgtgtacatggggccacggcacccagctgcgccagccagtttcttgtttttgccgctcccacaccacgcccagatcgccacggatagcgaacggacgattcaactccgcagagactttctggttgatagtcggtttgagtcgattccagtcaaaagttgcaatcaaaatgatcgccacgacaatcaacaacaagaaagcccctgaaatcgcagcggttattttgcctgccttgctcatcgttcgcttcctcatattcttcctgtgccagtcctaaagatagtccagccaggcggaaaatgaggcagcttatagcgccagaaccgccgtattcagcgtttctatcggtgccgggcgtgaaagaaaccagccttgtgcggcgaatgcgggcgagttctgaacatcacgccactcttccggcgtttctacgccctcgacaatcaccccgcgacaatagcgattcattagatgtaaaagctgagaaaagagtgtgcgtccttccggcgactgacgcagcatcacaaacagttctcgcgcgattttgatgtagtcataacgcacttcacttagcgcagagaaatttgccatcccggtaccaaaatcatccagccacagcgggccaaattcacacatcgaggcaaaggttgaatctttcggcagacggatatgctccaccagttcgaaacgcagccagggaagacgctcaatctggcgcaggatttttggttgctgacgcagggcgatgagcgtagggccatcaatattgaccgatgccagcaggccgtgctctataaagaagtcggctttttgcgccagcaaatcaatctgctctttcacaacctccatccgatggctgacggtgatttcagtaaaatagcgatccggcggcaggcgttgcgaagggttcaagggatgcgtgaccaccgttaatagctccacggccattaaccgcccgcatgtttgatagatcggctgccaggtgtaagcacgctcacactgcaaccaaaaacgccgttcctgcaagctctcgatgcttgcttcagggttgcttattcgctggataacctgccttatcatcaaagatgtcctgtgtttaaaagtgatgctgcccggactcgacaaagattatcggcgcgtaagggcagaactttaccgcctggccggggtaaatttcctcactccacaacggaatctttcaggaatacgttctggctcaaaaaaataatggaacactgttttaatatggttgaccagcaaaccaccacagcgcaaactaacgctaattttttacagatcaggttcacgactatgtccaaaaagattgccgtgattggcgaatgcatgattgagctttccgagaaaggcgcggacgttaagcgcggtttcggcggcgataccctgaacacttccgtctatatcgcccgtcaggtcgatcctgcggcattaaccgttcattacgtaacggcgctgggaacggacagttttagccagcagatgctggacgcctggcacggcgagaacgttgatacttccctgacccaacggatggaaaaccgtctgccgggcctttactacattgaaaccgacagcaccggcgagcgtacgttctactactggcggaacgaagccgccgccaaattctggctggagagtgagcagtctgcggcgatttgcgaagagctggcgaatttcgattatctctacctgagcgggattagcctggcgatcttaagcccgaccagccgcgaaaagctgctttccctgctgcgcgaatgccgcgccaacggcggaaaagtgattttcgacaataactatcgtccgcgcctgtgggccagcaaagaagagacacagcaggtgtaccaacaaatgctggaatgcacggatatcgccttcctgacgctggacgacgaagacgcgctgtggggtcaacagccggtggaagacgtcattgcgcgcacccataacgcgggcgtgaaagaagtggtggtgaaacgcggggcggattcttgcctggtgtccattgctggcgaagggttagtggatgttccggcggtgaaactgccgaaagaaaaagtgatcgataccaccgcagctggcgactctttcagtgccggttatctggcggtacgtctgacaggcggcagcgcggaagacgcggcgaaacgtgggcacctgaccgcaagtaccgttattcagtatcgcggcgcgattatcccgcgtgaggcgatgccagcgtaaacgcagcatatgcaaaaggctggataaagtgttacccctctatccagctcatccataaatacctgatggttgtgctaactcatcaccatcaggcattactgtgcaggtggaatatccgtcacttcaggatgtacgtcatccgtggcgacagaggtggtcgcagcggcggtagatggggccatgatttgatcccagaccgcctgcaacgctttcatgttaaattccggctcgcctttcggctgcagcagtattaacgccatatcattcgacaactgttgacgcagatcctgatttaacatctctaccgtcaggctattaaggaaatcctgccgcagtttctgatattgctccggcgcgatatcgacaacctgattttgcaacgaacgcatccgctgacccatcagaatatcggtatcagctcgtgcataggcggcaaacagtttctgcagctccagtttcttttgcgccactaacgcattgaactcttcttccggcagacctttatcgcgaaccttcgccagttcacgcgccaccagattaaggttgctgttcagcttgtcgtttggtgattcgatgttgatggcacactgcgcacgcagatacagcacacggcagtcaaatccaagaccgatgtctttgctgttactggcacttaacgcttgctgaacatgccagaacagcgcctcgcgggccaggtccgcacgccagtagcgcagcagtgcggctgattcacgaatcggctgccacggcgtatcccacatgatagataaccggtcctgacgcaccgcgtcagtcataatactcaccgcttccgcacgcagcggagaaagcgtcggcaccggagctggcgtttcacgtttgcctttcagttcgccaaacgttttgtttatttggtcgacaaccgagcgcgcatccacgtttcccaccaccagtagcgtcattgcatccggggtgtaccatttctgatagaaatctttaattttttccgcttcaacgggttgtttcagcggatcggcaggatcgtgacctaacaaggttgaccctttcagacgatagcgccaccagccctctttagtatcggcaggccaggttgccaccatgtcctgactttgcagcgcgtggttgatggtttctggtgtgatggtcaatttgccagtggcatttgccagataagagagcgcttctttcagcaaatcgttacggttattgggcaaactcagattaaacagcgtggtgtcataagagacaattaccggcggcatcgggcgtttagggtcgatcccctgctgccacaatgaacgcgcctgtgctgcgtcaaggccaccgctttgcgttagcgcaatacgagggatggcgtgactgtaaccgctctgttgtgtactttcggcgagcgaaccggtattaaccagcaggcgaatttcaacacgatcgctgggacgctggggggtggtcagcacttgccactgtaaaccgttggaaagcgtcccctgttgccatgctggatcaggctggagcgcatctgcctgcacatagccagcagtggccatcatcagcaaaccgcccgctaaaagtcgaatttttgtgccctgcatgtgaacccctgatcaactatcctggtaataaaaaaactgcccgttgtcggtcagtctaaatgacgttaaaaacacttcgtgttagaccgcaagaacatgaaaatgtcacggaagaagtgaaataaacctgaactcacccaggtggtaagttcaggcacaggggtcaattatgcgcaaacacccgcactcggggaagggagtgcgggcataagtgatgagattaagaggataattcgtgcgttttgccatccggcgcacgattattcagcacatcgtccagttttttgtggtccagttctttcacccacttagcaacgacaatggtcgctacgccgttaccgaccaggttagtcagcgcacgagcttctgacataaagcggtcgataccgaggatcagcgccagacccgctaccggcaaatggcccaccgcagagagcgtcgccgccagcacgataaagccactacccgttacccctgccgcccctttagaagaaagcagcaacacgattaacagcgtgatttggtggacgatatccatctgactgttagtggcctgggcgataaacaccgccgccattgtcaggtatatcgatgtgccatcaaggttaaacgagtagcctgtcgggatgaccagccccaccaccgatttacggcagccgagtttctccatcttgtcgagcatacgcggcagcgccgactcggaagatgaagtccccagtacaatcagcagttcttcacggatgtagcggataaatttgaagatactgaaaccagtcgctttagcgattgaacccaataccagcaccacaaacaggatacaggtaatgtagaaacagataatcagctgccccagttgcaccagtgtgccgacgccgtatttaccgatggtaaacgccattgccccgaacgcaccaataggtgccagacgcatgatcatattgatgatgccgaagatgacctgcgagaaactttcgatgacgttaaaaatcagttggcctttgctgcccagacggtggagcgcaaaaccaaacagtacggcaaacagcagcacctgcagaatgttaccgctggcaaatgcgccaatgacgctcgccgggatgacatccataatgaaggcgacaatgccctggtctttcgcctgatcggcgtaaaccgctaccgctttcgcatcaagcgttgccggatcgacgttcattccggcaccaggctgcacgacgttaacgatgataagaccaataatcagcgcgatggtactgacaatttcaaagtaaagcagtgcgactgcgccggtacgaccgaccgccttcatgctttccatgcccgcaatgcccgttacgacggtacaaaagatgacaggagcgatgatcatcttaatgagcttaacgaagccgtcgccaagcggtttcatttgctcgcctatttcaggatagaaatggccaaggagaataccaatggctatcgctgtcaggacctgaaagtaaaggcttttaaacagagaggttttcatagggtgtcctttagtaaaaccacaggtcttgtaaggttatggggtacctgcggccttaaaataacacccagacaacatcacagaaatgtacctggatcataattgaaacaaaaaggttaaaaagtttgagctggctcgcacaaaccagcactttttaaagttttgtaatcagtttggggtagctacttttcttccaggtaactctcttcgaagatttcaatagggagtgggcgagcaaaaaggaagccctgggcaataccaacgcccgcttttgccagccagtcgcgttgtgcttcagtctccacgccttcggcaatcatttgtaagttcaggctctgcgccagcatgataattgcagcaatcatgctgctatctcccggcaagccttcaacaaacattttgtcgattttcagtacgtcgattggcaacgatttcatatgctgcagctgacgcagccctgcgtagcccatgccgaaatcatccagcgccacccgaactccggcattgcgcagcggacggaggattgccaccgcagcatgagggtcgtcaatacgtcggctttctgtcacttccagaatcagtgttcccggctgaatgcgatagcgggttaacagttccagcatatccgccaccatattcgggtgcatcagttgcagcgcagagaggtttaccgacaagggcagcataatgccgcgctcttgccaggctgcaagcaatcgacaggactcttccagcacccagtgaccgacggtaaccatcagcccacagcactcaatgcgatcgattaagccatccggcaggtcccaactgccatccggttgctggatacgcagtaacacttccgcactgaccagtttaccgctggtcatctcgacctgtggctgtaaccaaatagcaaactgatgattttccagtgcattaaggatatcgctctcttccgtcaaccgcttctgggcggcttccatctgctgcggatcaaagaactgaatctgattcttgcctttatggcgagcggtaaatgccgcagaaatagcgcgactgtaaagctgttcggcggtgagatcgccgtagaacatcgccacgccaatgctacagtgcggacggagttgaatacgttcaatcggcaggcgctcgctcatgatagtgagcacttgctgacctaaggtgattgcgtgccacggttcctgtacaccgttggcaatgacagcaaagtcataaccgctaatctgcgcgaggatcatacgtggcgacagtaccgatttgagtttttccaccagcgtcagcagcagaatttctcgttgcgcctctttcagcacgcccgcagtatcacgcagggtttcacaggtgatgatcatcagcgcggtggtttgtttacgcgcgacaacctgctccagcatctccatcagcaaggctttgttcggcaaatccgacaccgggaagcgcatcgcattttcgttctgttcttcataatggcgctgcagcaattgctggttgaggttgtaactgcgcaccaacataccgatttcatcgtcctgatgcagacgcggtaatgccagttggtgaccaacaagctccttggctgggatggcgttaagttcgcgagcaatattgcgtaacggatgcaaaatcaggcggttaatgcaccagctgatggcgacggtcaggataagcgacaaaagtaagtaaatggtcactaacgttgagagggtgctcatcacgaacttatacatacggaaggaatccgcctgtagtaccagataggcaattggctgcgggtttgccggacgttcgagcgagtaaacgcccagcgagatttgaaccggtagctcaaacaggcgagtaaccattaccggcaccgggcgctctggaataaaacttttacgcagcgcctggaactggttaggcagcactacatcggcacggctgaccacgcctgccggtttaatgctggcaagaatagcttccgcttcgggaatatcgcctttcaaaatagctgaagataagggttcgcggacagagcgagcaatgctttccagttgcgtagccgtgttatagcgattctgctggaccagatggaacagcaaaacggtgcaaaaaataaaaacgaacaccaggacaacggctgccaccattgccatctgcttgattgttaacgagcgacttacgcgcaaattgtctccccccggaaatcccagattgccgcccgagtatacccgatcgcagcggcattaagagaggcgctatctgaaaacttaccagtcggcgtaaggtatcagcggctgcggcggtaaatccatgtcaccctgccatccggcggcggaataacgtacgtagagcaggaaatggctgggtgcgtaatctttcgcctgctggatatcaattgccgtgccaacaaaccagttggaagtaacacgtcgttcaagtaatgcccgcgccgtgtagccgaagccctgactgctgccgccatcgttggattgccgcgcagcttcttcctgccagtcggtcgggatcagattcatcagcggataacgcggcatggttttggtgcgtgaatgcgaccacgagccagacgcacccagctcccacgaccagttttccgtgcgctcccgccacatcaccggtatggcaaacgacaggtattcctgcggactgtagtaaccgccctgaccgagtgagtagccactcagatctttgtcgtaatgccagatcatgttgttcaggccgattgtgacgcggcgattgttctggttaatgaccttatagtaatagcccgtcatccagcgcacgcgccagttatcttcgacatttttaccggttaactggtcgccactaagcgatgcccagacgccgtttgcttcacctttatcgtagctcagacttagccccacaccgtcggcacgtacgccaccccattttttcccggtattgctcggggagtctttttgcccaccaaaggccagcaaagaactggagatgggccgacggtgggcgttaacggtgtaacccagcggcccgatatcatcgctgtaactgatgccgccgaccacatccaccacgttgaagcccatcggcgtggtaccgatatcccagctccagacgtcatttcgccagccgaccgccacgctggcaccggaatccgactggctgcggttgccgctacagtcctgtaatgtacaggtgccccagttgtcatcccatttgccatcggcattagtggagaaactgccgacgttcatattgacgaaatcactgcgaaagaacatccgcccgtcagaatacggcgcatccacctgcaacatggtagtgtgcgctttcagatcggagtaaccaccggtgccgctcgaaccccagtaatcgtgctcaagggtgacgttaagatcctgctggcgatagaggtccgccgcatcgctgcgcacgccacgtttcagccagtcatctttctcgtcgttacgggtcagtcgggtaaaggtgtcgttatcctgcggacgcgtcgtagtcacaccggatgcgaccatggcgtctttgtaggtttccagcgcctgcgttggatcgcccgcctgcgcttcaaacttcgcaccatcacgcagcaccatcgcgctttccatcgacggtggctgagattttgcctgcgggatcaacttattaaacgtccgctgcgctgctgcggtatcgccaagctgcgcctgtgccagcgccacgcgccgctgtgtgttcagcgaggcgttatcggtagcgggcagtttcgccagctggctacgtgccgccgctttgtcaccggcagcaatatccacttccgtcagaccaagaatggcgtcggcgttagctggctcccgcgtcaggacattctgatatgcagcgcgggcggcggtgtaatcacgtcgttgttgcgcccagtcagccagcgtgaggtcaatacgcgtggaaggtggttgctggcgcagcatcgcttccgcttctgcctctttgccgctttctcgcaggcggttagcggtttccagcacctgatcgctttgcagtcgattaaccagctcctgaatattgctgttccactgcgcacgcggcaggctattgatatgcgccagcgccgctctgtcctggtcatgaccagagaggtacagcccgtaagcgtaaacctgctccgggtcgttcgacttctgctgcgccagattgcgcattaacgtatcggcctggctgcgttgtccggcctgccagagatcctgcgaaagtcggtaagtaatccatacgctgccggggtccagcgccagtcgttgccgctgaagtgctgccgcctgcgcccatttgccctggttttccagtgcctctgcctgctgtgccagacggtcgttttgcaggctgcgttcgatatcatcaatgctacgccgctgactggcagagagcgaggcgataaacgcttcagctttttctggcgattgctggcggtaaatatttgccagcccgcgcacggcgttagtgttgccgctgtccatacgcaaggtctgctgataataacgttcggcggcgggataatcttttcgcgccatcgccacatcgcccagccccagcactgcataactgtcggtgttatcgacattacgcgcctgctggaacaggcgttctgcccggtcaggattattggctttcagcgcagcatcgccctgctggatcgccagccagtagcggtttactttcagcagactgttccatttgtcgttgttgctgctgtgcgggtccagtgcgagggctttttccagattcgccactgcattggcgcgatcgcctttctgagaatacgcctggcccagcgcccccagagcttcactgtctttcgggttcgcccgcaccgcctgttgtagttcgggaatggctttacccgccataccagagtccaccgccgctaaaccttgcgcacgagcgcggaaagcaggatcggccagctgtttttgctgttctgccagttgcgattgcgcagccgccacgctatcgccatcactaaagatcgagagatattttttcagcgccgacacactggcatcactgacgggcatgtctttaatctgcccgtaccagattttagaggccccttcgcgcccggcgttcgattttgccatctgttccaggacggcaaaaccttcgtcacggcgatcgctactaaacagcaatagcgccagattgttttgcaggcccgtattgcccggtgcatccgcattgatgcgttttaactgattaatcgcttcgccacggcgagccggaattttcgccaccgtactccagtactcgacagcaatgtcaccttccggcggcgcaccgttgaacagtttgttgtaactcgccacagcttcttctgcatgaccggtcgtcgcctgcaatcgtgcctgttgcagtgcctgacgaccatccggcgtggaaagtagcatcgtagtccgcgacgatttatacgcatttgaactcggcgctaactgcgacagccgatcgagctgtttttgcgcgccatcaatatcgccctgacgtaacaaagaacggaaacgggcggcaacgacgtccgggttattcggatcaataagttccagccgatataacgactgttgcaccagatcttcacgatgggtcgcttcgcctaaccgaacttgctccagcaactgttgctgagcggttggtgctgcctcgaccatcggcatgacggccagaccgagggaaagcgtgaatatgtttagtgtgaatttgcgcattcctggccccagtcaggtaataactcaccttttgtcgagaagcggaaacggtgttgatcccagccttgtccaaacagggtcagcacatagttgtaataggcatcgctgccgggaaagttatcggccacgcgctggcgctgaacggcctgcgcatcgcggttttgtaaaaagggcagcatggcggcagaaaaaccgactggtcctttaccctgcgctttccccgtagccacatccactttttccggcggataaccgtttttctcagtgaatgtcgccatcggtttaaaccggttgagcatccgcgctttttgcggatcgctgtcaggcatcatgcctacccacatgtaaacgcggatagcgtcgtagctgctgatcaatgttttttcggcttttagctgccagcctttgtctttctcatagcgcacccagtctggcgaaaaacctttcggggcggtttccagcaataaacgttgattggtttcgcgcagcgtggtccacggcgcgccaaagcgggtgaaatactgcgccagcgtcggcggcaggtagctggggttaaaacgccagctgttatcctcagcaaaacccactttgcccggtaacaacatggaacccagcccaggcaccgtcaccacttcctcccgcgcgatacgttttagcaacgcgctgccgatgtcggtataacgctgctctttccacaaacgccccgcctccagcaacgaccaggccatccagacatcaccatcggaggccgaattgctgtccagcacttcccacttactgttctctttcttgccccacagccaggcgggcaaacgttcttttaaagaaccctgagcgagattgttctgcgtccagtcgagaatattatcgaaagctgcacggtcgttagccgccagggcagagaacatgccgtaactttgcccttcggaggtggtgattttgcgcgcgtcgctggggtcgatgacgcgcccttcctgactgatgtaatcctttttaaactgctcccaggcaggccaggtacaggctgcctgaacactaaaggcagccagcagcagcatcgtcacgattccactacgcaacacattcatcttcaattactcgttatccgggttaagacgacgacgactaataattcgcagcagacgccacagtacccatgccagcaatatcacactgatagccgccagcaccgccagcagaatcggatggtttgccagcgcataccacacgcgctcgaaccacggcagatgacctacgtaataaacgtcgccaacacgtaggctgttgataccggactcgcggatcaccgcgaccgaaccgaacatggtggcgcgtttgccgctatcgttcaccgcatcgttaagcatttcataaccgcgtgggctatctgccaacagcgcaatcacgctgcgctggtcgttatacggcgactggaagccaatcaccgccgccatcgcaccggaagaggtcagcgttgaccgggtttctgccgcgcgatcgctctcgtccggcacaatgccggggaacggggtctggcgcatcggtgttttcacccagctttcggtcgcctgcaccaataggtcgatctgcttatcgtctttcagtttgtccgggataccaccgatgatcatgatgtcggcatctttgccctgaatggtgctgccatcatcggtcaccgtcagattaatcgccgggaagcccgtctgtgcgccgataaaaccaacagtattcagcaacgtttccatctgtgcttcgttaggcgctttcggcatcacggtgatggtttgcgacagatccgccatccggctgaatgggaagcccgcgttagcaaaggcgcgtagatccggcatcgggatgaagtggtaatacttcgagaagtcgatggtggagtcgtcaccaatcaccacatgattctgcaccggctggaaggtaatacagttatccaccgaaccgcccggcatcgggttcatatactcaaagtcgaagcgcagctggttggtcgcgcccagtttcagcgccggaatagagacatctgttttgccatccagcaaaccttgtaataccggaatccgcagcagcaggcggttcgcctcctgtttgctgctcaggttgaaggattgcaggaactggttattcaggctgatatccatccgcgaactgtctttcaccggcggcatggtgtagcggtaattaatatccatatcaatgccggtactgcgcatcaggtagagatccggcggcaggtttagcgaaacgttaatcgctgctggctcaagaccgctggattgtaactgttcttcataggttttcagttcgccaaatgtgaccggacgatcggtacgtacccagttcggcgcatcgtacggcttacgcggtagcagcggtttcacttcattcactaccacgctttcaccacggaacagaatgttaccctgagcgatacctttcgctgcctgcaacaggtctttgtcgtcacgaccaaacaccaccagcagtttgacgtaaggattctgcggatggttaatcatctcaatcaccggggcttttaccgccggatgatcgcgcaggaagtccggccgtttgtcgttggttgcaaagacaatggcattgcgatccggcagttggttatagagtaccgggaagttctgcccacgccagccagaacgcgaaccaaaccacgaggcgacaatggcagaggcttgttgcagcccaacatccggcgcacccgcaaagaccatcggcaaggtgttggtgcggttatcgctcgggtcaaagaatggcaccgggaagtgtgacaggtcattcttcacattcagggtctgataggtcagatccagtccactgctccgcccaacatccagccaaagcgtggtgctggccggtttttcgcacacgtcctgataatggccgacaaactccagccgtacacggttgaagtcgctaataaacagtgggttaatgggcatttgcgccagcgtttttttacccaactgttctttggtcactggcagcacgcccatcagttcatcattgagataaacctttaactgcgactggacaggcagtaacgatggcgatggggtgtattcgaggttgagcatcgccttcgtcaccacttcatcgctgcgcataccaaactcaatgctgccgttcgggttaatgccacgtagcaccatgctgcccggcggcggtgcaatttgcgcaaaggtcagcttcacatcacgcgaaggaccgttctgcgccacgactggcgcatcagcgccctgcacgcccggcatcacttgccccacctgcggattttgttccgtctgggcggctacagctggctcagcattgatcagtggttgcgttgctggcgtcgcctgcgtcatgaaagaggggaacgcactcatccccatagccactgcacaaatccagaatagttttcttttcatcgcgttatcatcattgttgagccaaagcctgatccgatggttgtgccgtttcgctccgctccgggcggcgcggaataaacgatacaacccaggaaaccagagaagtcagcacacggaatatgcccttcaccgaagaaggcgcaaactccgccagatggcggtagccacggaagccgagcttcagaatatccagcagactttccagcggcttatcttccgggtagctgtcctgccagagcgcccatgtatccgcacgggcaaacgtacactgcacaaaatcgatatgttgctgggtggtgagcggcattaatttcagcccaacttcattacccatcacgcgcgccacctgggtcgggaagacgtattcctgctgaccgcgtttaagcaacagattcactttctgcccttccagaatctgcgcctgaccgttgatcttgatccccaaaccaccgtcggagaaatcctgaacggtacacgagaagaggtgaccatcttcgcgggcaattgccgcgggcatcgtcatctccacgcggtgcgatcggcgtacctgtttgctttctaccgataccgcaactgcgccgccaagaacaatcaggttgtagaacacccacaccatactgacgaccacggtgagcatctcggttggcgggccatagaagtagcgccagatgcctaccgcaacgcccaccaggttgagcaggacaaggaagatgtagggccgcgagatcacccagtcgacgtactcttcttccaccagtccacctttggcggtgacgttaaatttgcctttgtgcgggttaatcagcgccaccagcgtcggtggtgcgatataccacgccagcaccgtttcgtagatttcactccagaaagagtggcgatatttgccctggatcttggagttggtcaggctggcatggatcatatgcggcagcacgaatagggcgatcatcaacgctggcgcatagatgatgtaggcatgaagcagcaggaacgccagcggcgcagtcaggaagatcagccgtggaatgcccgacaagaagtggaacatggcgttgacgtaacatagccgctgagcaaacttcagccctttaccggtgagcgggttatcgagacggaagatttgtaccatcccgcgcgcccagcgaatacgctgaccgatatgcgccgacagactttcggtcgccagccccgccgcctgcggaatacgcatatacgcggaggtatagccacgacggtgcaaccgcagagaagtatgcgcatcttcagtcacggtttcgacagcaatgccgccaatttcatccagcggcttacgacgaatcaccgcacaggaaccgcagaagaaagtggcgtcccacatatcgttgccatcctgcaccagaccatagaacagcgtgccttcgttcggcgttttacggaaacgccccaggttgcgttcaaacgggtccggtgagaagaagtggtgcggcgtctgcatcatcgccagctgtttttctttcaggaaccagcccatggtcatttgcaagaacgatcgcgttggtacgtggtcgcagtcgaaaatcgacacgaactcgcctttggcatatttcagcgcattgttgatgttgcctgctttcgcatgttcatgagtggtgcgggcgatatatttcacccccacgttttgcgcaaactggcgaaactcttccctgccgccgtcatcaaggatccagatattcagcttatctttcggccagtcgatacccagcgaggcgtaaatggtatttttcaccacgttgagatcttcgttgtaagtcgggacaaagatatccaccgacggccacagcgacatatctttcggcaatggcaccggctgacgattcagcggccatactacctggaagtagccgagcaccagcacaatccacgcgtacgtttcagcgaagagcagaataagcccgcacaccaggctgaccggatcgtcccagttcagcgtagaggtgtaacgccaccagatataacggcaagaaacggtcagcgacagcacaatcaacattagcgccgagaagcgccccggcatccgccgtacgatcagcgctaccccccacagcagcatcaggaagataaactgcgccagcgggttaaacggctgagtaacgcagattaacgccagaatcagcgagaaggtgacgatgataccgaggatcaaccgccgcgccccggcactcaaatgaccgagctcttttttctcatccagatgctgtgttttatggctaacgcgctcaggcagctcgttcatccattgatggtaacgtccacgaatattttgcagacctgaaaatgcccgcctgcgcggtttcggcgtttctttgcgcgatgcaccgatcaataaccagcatgtttgaatgagataacggaccgggtccagcggacgcggacgcgaggcgttgatatgcggatacaggtttttatgttctgcgcgaatacgctgccagcgcgggtgctccagcggaataaaaatccaggccaggatcatccagaaacagccgagcgtcgcgctgaaagccgacgcaccgtgacgacgataatcgcgataacgcccgataagccgcgcgttgaccggcgggataagcaaccaccgggtcaggatactcatgatgcactcccgactggcgttttcagcccggagtagttcaacaggcaccagttcgccagcgtcagtatctcttcagccgccagcgcatcactgcgatattcacctactggttgcttagccgccaggcattcagccatcgcttcatcacgatgaatgagcatcggcagtaatcggcgctggctttgcaaccaaagctggtaaatatcgtcctgaacctgactgccaatacggaagtcattaatcaaaatatgtgcgccatccggcagcgcttgctgatgcagtcggatatggcagttggcatccacattgacgattgccagcgagtgatcgcacaaactcagcagctggtgggttatctgcgaggcatcacgcggtaagtcgattaaaatccactggtaacgcccgctggcttttagttgctgtaagccggagcaaatatcgctcagccgggtttgccagtgctgtggattttcttgttcttcaatggataactgaccaaaaggcagcaaatcgagctgcgaggtgtagcgcaacccagcgtcacgccagtcctggccatccagcatcgctctggcccagccctgacggtgggtaaaatcaacattaaatgacaggcgcaacaagttgtccgggcaggcatcgaccaccaggacattttctcccaacatttgtaatgaccaggctaatgcggcggtgatggttgttgtccccacgcctccccgcaccccctgctatcccagtacggccattcaccaatcccctacttttgttgcgcaaactctgccagcaacggccagcgttttaatgccgcggccaactgttcgcgttgggaaatatcggcataatcaatatcaggcagtgaaaatgcctgctttaacgccacaatatcattctggaagatatagcctatcgcgggatcaggcagagtatctggttcattgttattcattttgcttgatccctatgaaataaccgtaccgttcatgagacaattctaaccgtgagcatttcgccggtttattgtttacggcgagacgggaatttgctcactttttgactttccgttacgcaacagaaaaagttaaaaacgaaaagactaaaatcacacgtcttgtgaccttctaaattgattcacatgctaaatctgataagttttaatttcaatggtaggtttatttcttagctttcgctagtaaactgataatcagacaaaatggtgacatgagggacattgtggaccctgtattctctatcggtatctcatcattatgggatgagctgcgacatatgccagcaggcggcgtctggtggtttaacgtcgatcgccatgaagatgctatcagtctggcgaatcaaacaattgcatcccaggctgaaaccgcacacgtcgcggtcattagcatggacagcgatccggcgaaaatctttcaattagatgattctcaagggccggaaaaaataaaattattttcaatgctaaatcatgaaaaaggtctatactatttgacccgtgatttgcagtgttctattgatccccataattacctttttattcttgtttgcgcaaataacgcatggcaaaacattcctgccgagcggcttcgctcatggttggataaaatgaataaatggagcaggttaaaccattgttcgcttttggtaattaatcccggaaataataacgataaacaattttcattgttgcttgaggaataccgttcactttttggtcttgccagtttgcgttttcagggtgaccaacatttgctggatattgccttctggtgcaacgaaaaaggggtcagcgcccgtcagcagcttagcgttcagcaacaaaatggtatctggacattagttcaaagcgaagaggcggagatccaaccacgcagcgacgaaaaacgcattctgagtaatgttgctgtactggaaggtgcgccgccgctatcggaacactggcaactgttcaacaataacgaagtcctgttcaatgaagcccgtaccgctcaggcggcgacggtggtcttttctttacagcaaaatgcgcaaatcgagccactggcccgcagcattcataccctgcgtcgccagcgcggtagtgcgatgaaaatcctcgtgcgggaaaataccgctagcctgcgcgccaccgatgaacgtttgttattggcctgcggtgcaaatatggttattccgtggaatgcgccactctcccgttgtctgacgatgatcgaaagcgtgcaagggcagaagtttagtcgctatgtgccggaagatatcactaccttgctgtcaatgacccagccgctcaaactgcgtggtttccagaagtgggatgtgttctgtaatgccgtcaacaacatgatgaataaccctctattacctgcccacggtaaaggcgttctggttgccctacgtccggtaccgggtatccgcgttgaacaagccctgacgctgtgtcgccctaaccgtaccggcgatatcatgaccattggcggtaatcggctggtgctgtttctctcattctgtcggattaacgatctggataccgcgttgaatcatattttcccattgcctactggcgacattttctcaaaccgtatggtctggtttgaagatgatcaaatcagtgccgagctggtgcagatgcgcttgcttgccccagaacaatggggcatgccgctgcctttaacgcaaagttctaaaccggtcatcaatgccgagcacgatggtcgccactggcgacgaataccagaacccatgcgactgttagatgatgctgtggagcgctcatcatgatgaccatcagcgatatcattgaaattattgtcgtttgcgcactgatatttttcccgctgggctatctggcgcggcactctttgcgacgcattcgcgacaccttacgtttgttctttgctaaacctcgttatgttaaaccggccgggacgttacgccgcacggaaaaagccagggcaaccaaaaaatgactcaatttacgcaaaataccgccatgccttcttccctctggcaatactggcgcggcctttccggctggaacttctattttctggttaagttcggcctgttgtgggcgggatatcttaacttccatccgctcctcaatttggtgtttgccgcgtttctgctgatgccccttccgcgctacagcctgcatcgcttgcgccactggattgccctgccgatcggctttgctttgttctggcatgacacctggttgcctggcccggaaagcataatgagccagggttcgcaggtggcggggttcagtaccgattatttaatcgaccttgtcacacgctttattaactggcagatgattggggccatttttgttttattagtggcctggttattcctgtcacaatggattcgcattaccgtttttgtggttgccatactgctatggctgaacgtacttaccctggcgggaccaagtttctccttgtggccagccggacaaccgacgaccactgtaacaacgacgggtggtaacgcagcggcaaccgttgcggcgacgggtggcgcaccggtagtgggtgatatgcccgcacaaactgcaccgccaacaacggcgaaccttaacgcctggctgaataatttctataacgcggaggcgaaacgtaaatcgaccttcccgtcttcgctgcccgctgatgctcagccatttgaactactggtgattaacatctgttcgctttcctggtcggatatagaagccgccgggttgatgtcgcatccactgtggtcgcatttcgatattgagttcaagaactttaactccgccacctcctacagtggcccggcggcgatccgtttactgcgcgccagctgcgggcagacttcgcacactaatctgtatcaaccggcaaataacgactgctatctgtttgataacctttcgaaactgggctttacccagcacctgatgatgggacataacggccagttcggcggttttttgaaagaagttcgcgaaaatggcggcatgcagagcgaattgatggatcaaacaaatctgccggttattttgctgggctttgatggttcgccggtttatgacgataccgctgtgcttaaccgctggctggacgttaccgaaaaagataaaaacagccgtagtgccacgttctacaacacgcttccactgcatgacggcaaccattatccgggggtcagcaaaacagcggattacaaagcgcgggcgcagaaattctttgatgaactggacgccttctttactgaacttgagaaatcgggtcgtaaagtgatggtggtcgtggtgccggaacacggcggcgcgctgaagggcgacagaatgcaggtatctggcctacgtgatatccctagcccgtctatcaccgacgtccccgttggggtgaaattcttcggcatgaaggcaccgcatcagggggcaccgattgtcatcgaacaaccgagcagcttcctggctatctccgatctggtggttcgcgttctcgatggcaagattttcaccgaagacaatgttgactggaaaaaactcaccagtgggttgccacaaacagcaccggtctccgagaactcaaatgcagtagttattcaataccaggataaaccgtacgttcgcctgaacggcggcgactgggtgccttacccgcagtaagaacgaaaaaggccgcagagtttcccccctgcggcctggtccgggcgcaaattgccattacggcagcctgacgcccgcatgacacgttacttccgcttgttcagccagttcacgatcatactggcaagaatgccagcaatgaccggagccgctaaatcatgccagaaggccatgcccagctctgcgaacgtcatatagccgcctgtgttgtaatgacaacgtttcgcggctattcttgagtggtctagagtcaagattagcccccgtggtgttgtcaggtgcatacctgcaacgtgcgggggttttctctctccagcaaccaatgccaccagggataaagcccccgcaacattgcgcctcaccggaacctttccggcttgccgctgattctacgattgctttttactgtcagcacccggcaatcttcctcattgcgcgatgccttccagcttaatttctttatttgcaatagttgcagttcatatccgggctgactccagactggtagtgaaatgcgcaattttgtagaattgcgcctcctcgcgacctccccagtgaatctgttgcctcattttttacatactgcgtattcgacttctccacctgttgcgcaagagaaactgggtttattcatttttgcgaggccgacttctttctggacaggactttatgcagcacaacacactatcgaaacacaatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtgcaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttcacaatctctactttataaagtcgctattttcgccgtactggtggcgattgcgtctggtggtgaacgattactgtttaagatttccgggccaatggtggtggtcaaagtagggattattgtcgtgttcggttttgcgatgatcccgcactggaatttcgccaatataaccgccttcccgcaagcctccgtctttttccgcgatgtcttgcttaccattccattttgcttcttttctgcagtatttattcaggtacttaacccaatgaatattgcctatcgtaaacgggaagcggataaagtactggcaacccggctcgcgctgcgtacccaccgaattagttatatcacgctcatcgcggtgatcctgttttttgccttttcgtttaccttctcaattagccacgaagaagccgtttctgcctttgaacaaaatatctcagcactggcgctggccgcgcaggtgatccctgggcatatcattcatatcacctctacggtgcttaatatctttgccgtactgaccgcattctttggcatttatctcggtttccacgaggccattaaaggcattattctcaatctgttaagccgaattattgataccaagaaaattaactcacgcgtgctgactctggcgatctgcgcttttatcgtcattacgttgacgatttgggtttcgtttcgtgtatcggtgctggtgttctttcagttgggaagcccgttatatggtattgtgtcgtgcctcattccgtttttcctgatctataaagtcgcacaactggaaaaacttcgcggatttaaagcctggctgattctgctgtacggcattttgctatgcttgtcgccactgttgaagctgattgagtaaaccggagcgcatggccccggttttgtgagttaacgctgcggattttcatcctgatcaacagcaaaacaagctaccagttgaccgccgtagtcttttagctgcggctgcaactgggtgcaggggccgaagcgccgacgacagcgggcgttgaaggcgcaacccggcggtggattcagtgggcttggtagttcaccgctgagcttgatgcgctcgcggcgatcgtccgggttcaggcgcggcgtcgcggaaagtagcgcctgagtgtacggatggcgcgggttattgaagatttggtctttcgttcccttctccacgcagcggcccaggtacatcaccatcacttcatcagcaatgtgctccaccaccgacaggtcgtgggagataaagacataagacagccccaactcctgctgcaaatccatcatcagattcagcacctgcgcgcgcactgaaacatccagcgcggaaaccggttcatcggcaatcaccacatccgggtcgagcatcagaccacgggcgatggcgatacgctgacgctgaccgccggagaacatatgcggatagcggtcatagtgctcggttttcaggccgactttcgccatcatcgacagggctttttcccgacgctgttctttgcttaagctggtgttgatcagcagcggctcttcaagaatttgcccgacttttttacgcggattcagcgaaccgtaagggttctggaagacgatctggattttctgccgacgcagcttctgcgcctgcggatcgtgcttaagcagatcctgcccctggtaatacagctcgccaccggtgggcatttcaatcatcgtcagcaaccgaccgagggtcgatttaccgcagccagattcgcccactactgccagcgttttgccacgttcaaggttaaacgaaacgccatccagcgctttaaccagacgttccggcgcgaacatgcctttcttcaccggataatgttttttcaggtcgatagcctgcaacagcggttgttgcagggtggcctcttgcgtactcatagtgtcggcctcccggcatcatcaagtgggtaatggcatttggactgacgcccgtcagcgagcatattcagcgccggttcttcagcgcgacatctgtcagtggcataggggcagcgcgggttaagcaggcagccgttcgggcggtcgtacttgccgggaacgacacctggcaacgacgccagacgttctttgtcctgagcaaattctggcagcgcacgcagcaatgcctgagtatacgggtgacgcggcgcatggaagatggcgtgcgcatcaccggtttccaccacctggcctgcatacatcacgatgattttatgtgccgcttccgccaccagcgccaggtcatgggtaattaacaccagcgccatgttctctttctgctgtagctccagcagtagttcgatgatttgcgcctgaatggtcacgtccagcgcggtggtcggttcatcggcaatcagcagttttggccgacaggcaatcgccatggcgatcatcacgcgctggctcatgccgccggaaagctgatgcgggtaaacatccagacgcgatgccggatcgggaataccgacctgattcagcaggtcaatcgctcgctgacggcgggtacttttgttgccgccctgatgcaccttaatcgcttccataatctggaaacccacggtgtagcacgggttaaggctggtcatcgggtcctggaagatcatcgccacttcggcacccaccaggttgcggcgctctttttctgagatacgctgcaaatcctggccgttaaactccagtttttctgccattacgcggcccggataatcaatcagccccataatcgccagtgaactgaccgacttaccggagccggactcacccacaatcccgaccacttcgccctgttttacgctgtagctgatgcggtctacggcgcggaacggcgcgctttcgtcgccgaaatgcaccgataatttatctacatttaataacgccatctcgaacctcttactgcttcagtttgggatcgagcgcgtcacgcagaccgtcacccatcaggttaaatgccagcaccgtcagcaggatcgccagacccgggaaggtcacgacccaccaggcgctttgcgcgaactgcaacacgtcggagagcatggtgccccactcaggcgttggcggctgtgcccccatgccgaggaaaccaagagcagccatatcgagaatggcgttagagaaaccgagcgacgcctgaacaatcagcggcgcaaggcagttcgggaagatgttaataaacatctgacgcatcgccccggcacccgccacgcgagacgcggtgacgtaatcgcggttaacttccaccagcacggcggcgcgggttaagcgcacatagtgcggcaaggcaacgaaggtcagtgccagcgcggcgttaccaatcgacgggccgaaaattgccaccagcaccagcgccagcagcagacttggcagcgccagcatgatatcgaccacgcgcataatgatgttatcgaccaggccgccaaagtaaccggcgatcaggccgagaataacgcccataatcagcgataacacaactaccagacagccaaccagcagcgacaggcgcgcaccgtacatcaggcgcgacagcacatcacggcctacgtcatcggtgcccagcaagtgcgccatgctgccgccttcctgccaggctggcggggcgagcagtgcatcgcggaactgttccgccgggttatagggtgcaatccagttggcaaagatcgcgatgaacagcacgatgacgacgtaaaccagcccgacgaccgcgcctttgttgcgtttaaaatagtgccagaactcctgtaacggggtcatcggcaccggtgcgctaatcactttattttcagtaacctgtgacatgatgtccccttacttcttatgacgaatacgcgggttcaccacgccgtacagcagatcgaccagcaagttgacgaggataatcatcgtcgccaccagcaatacgccgccctgcactaccggatagtcgcggcgttgcagtgcgtcaatcaaccagcgtcccagaccgggccacgagaagatggtttcggtcagaatcgcccccgccagcaatgttcccacctgcaggccgataacggtcaccaccggcagcatcgcgttacgcagcgcatggacgataatcacccgcatgcgggttagccctttggcgcgcgcggtgcggatgtaatcctcgcccagcacttccagcatcgaggagcgtgtcatacgcacaatgaccgccagcggaatagtacccagcacaatggcaggcaagatcatatgggcgacggcatcgataaagttgccgtcttcaccccagatggcggtgtcgattagcataaaaccggttaacggattggagtcatcgaggaacaccatatcgctcacgcgaccggagacgggcgtcaggttccagtgcaccgaaaccagcatgatcagcatcatgccccaccagaagataggcattgaataacctgtcagcgccaggccaaccgctgtgtgatcgaaaatggaaccgcgtttaaccgcagccagcacgccgaccggaataccgactgccgtagcaaaaatcatcgcgcagacgccaagttccagcgtggcctggaagcgcggcacgaactcttcccaaaccgggatgcggcttttcattgaaatgcctagatcgccatgcataacgccccaaatgtaatggagatactgctgccacatcggtttatctaagccgagttcagccagcagctgcgcgtgacgctctggggagatcccacgttcgcccgccatgatcatcaccggatcgcccgggatcatgtggacaaaggcaaatgtgagaagggtaataccgataaacgtggggatgacgagtcccaaacgtcggagaataaactgcaacataacccggattctctatagtgacccgcagcctggaactgcgtgtctgtattgctcacaaatcaattcccgcccttatcggacagggaatgaagtattgctgccggatggcgctgcacgcagaggcacagcgccaccgggtatacagattgttgacaaagtgcgctttgtttatgccggatgcggcgttaacgccttatccggcctacaaaatcgtgcaaattcaatacattgcagaattttcgtaggcctgataagcggagcgcatcaggcatttttgcctttgccatcagtcttgtatggcttttaattattcgatagagacgttttcgaagtgatgtttgcctaatggatcaaccacatagcctttaacttctttacgtaccggttcaaacacggtggagtgagcgatgatcagtgccggagcctgatcgtgcatcaccacctgcgcttgtttgtacagttcaacgcgtttattgtggtcgtcggtagcacgcgccggttgaatcagatcttcaaacggtttgtagcaccattttgagtagttggagccttgttcagaggcggcgcagctgaacagggtggcgaagaagttatccggatccccgttatcgccagtccagcccatcattaccgtctggtgctcgccatctttcgcacgcttgaggtactcaccccattcgtaggtgacaattttggcctgcacgccgactttcgcccagtctgcctgaatcatctccgccatgcggcgagcgttcgggttatacggacgttgtaccggcatcgcccacaggtcgatggagaaacctttttccagacccgcttctttcagcaaggctttcgctttttcaggatcgtaggtgtagtcctgaacgtcgtcgttatagccccacatggttggcgggatcaggtttttcgctgatacgcccgcgccctgataaaccgctttgatgatcgcgtctttgttcaccgcgtaggtcagagcctggcgaactttcacgtcatcgagtggttttttctgcacgttatacgagagataaccgacgttcagccccggcatttccatcagattgatggatttatcctgcttcatgcgagcgatatctgccgggttcgggtacggcatcacctggcattcattcttctgcaatttcgcgtaacgcacggaagcgtcaggggtaatagagaaaaccagcgtatcgatctgcggtttggtgccccagtagccatcaaacgctttgtagcggatacgggaatctttttgatactgctgtaactggaacggaccggttccgattgggttgaggtccagtttttccggtgtaccggctttcatcatcgcatcagcatattcttttgacagaatagaggcgaagtccattgccaggtcagcgaggaacggcgcttccgggcgagtcagcacaaactgaacggtgttgtcgtccacctttttcacttcactgatcagctctggcaagcccatgccttcgaagtattcgtagctgccgccagaaactttatggtacgggttttgcgcgtttttctgacgatcgaacgagaacaccacatcatcggcgttcagttcacgcgtcggtttgaattctttattgtcgtgccacttcacacctttacgcagatggaaggtataggttttaccgtcttcgctgacttcccacttttcagcgaggcccgggatcacttcggtggtgccgattttaaattcaaccagacggttataaagcgggacggaagaggcgtcataggtggtgccggaggtaaacagctgcgggttaaacccttccggagatccttctgagcaataaaccagagttttagcctgaacacttgctgcgacggtcatagccaccaggctgagaccaagcttcagcatccctgactttttcaaggaaatacgcattattctgctccaattgtgatgtttgttgttttaaccctttgcagtgggttgtcgctgcctgaccttttttgttttttgcccggtcgggtcaacgttatgaggtggggatgccgtactaattaacatcagtgtaacagtgcggatcctccataaaatgcccctcgtgacctacaatctgtcaacagaatgtgaaaacgtcaatacagccaaccgggatttacaccaacggtgagaatccacacacaaagattaaaaaaacttcaaacagctatttgcagcagagaaatttgtgctactccaacatgaccagaacaatcagcttaatatttagcaacatttggtgattaagttttatgcatttaatgaaaaaaatctgaggaaaaggtggatatctgagcgattaataccatgaacgctaaaacgcacagcggaaaatgccagggccagccataagtaacgcaaaaaaagatttaagcaaatataaaaaaagacaatggtttctgtcacaaatccgttaatggatagtgagatatggggcgcaaatttggcagggaaatgtgtgtcgtgtaggtcgaataaggcggtcgcgccgcatccgacaatggccggcacatttgcctgatgcgacgctgacgcgtcttatcaggcctacgtcgagtcgaacctccctgcccccggaggttctcatcctcatgagctgcagatgcaaaaaagcctgctcgttgagcaggcttttcgaatttggtcggtgatagaggattactcgccacttcgtggctcgccctgcgggccgttgctggcgcaacgttctctcgcttcgctcgagtcgaacctccctgcccccggaggttctcatcctcatgagctgcagatgcaaaaaagcctgctcgttgagcaggcttttcgaatttggtcggtgatagaggattcgaacctccgaccccttcgtcccgaacgaagtgcgctaccaggctgcgccaatcaccgaatgcggggcgcatcttactgcgcagatacgccctcgtcaatcccttaatagcaaaatgccttttgatcggcgagaaagtcagcaggccgcttagttagccgctgcctcttttgcctgcgggatgtgacaccagttgttgttttcgttaattccaccatccggtgaagtatagccaagacaacccatgatggtatcgtacagctctacgtgacggcgtggcactttcatgtcggcttcttttttcagctgcgcaaacgcctgcgcattggccggattttccagatatttatctgacatccagaccatcatcggtacgcggaactgctccggcggtgccagttcacgcggcgtgccgtgcaggtgctcgcgttcattaattgactcaccgtggtcagctgcgtagaacacaatcgctttcttatcgcgaacctgatcaatcacgctggagataaagtgatccacataggtcaccgagttgtcataggagttgatcatctgcgctttggtacagccgctatcaacaccaatacattccggcttccactgcgcgaagctacgcggataacgctgggtgtagttaaaatgcgaacctttggtatgcagaatgatcagatgcttaccatccgggttgcgccctagcgattgctgcatttcgtctaccagcaacatatcatctaccggcttgccacgattacgtggctccgcaccaatctgctcacgataagcaatgttgtccgccatcgtgttgctgtagaaccacatttcgctctgcatagcgtagaggtcagaactgaatcctaactgcttcagaaccgcgaaaatgttctgttcttttaatgtgcgctgcggattatcttccgcgcccccctgacgtacaaacatgcaacgcagtgagagtttggttgcggtatcacaggagtaaccacggaacgccgccagatttttctcctgggccagtttcggcgtggtattacgctcatagccgaaaatacccatatggtcccaacgcgtggtttcaccgatgataaacacgacataagtgtcatcaacgttttgcggtgcctgataagtgaatttcttcgccggattaagcaatgaattattatcggaagattcatcgacccgcgcccaggcatacagccccaacgcagaaagccagtttgatggcagataagagttcgctacgacaccgccataactcggcaaatcaacgccggtcgccctctccactttcttctgctggatatccagcaaacgaatcggtgcccaaaccataatacccgccagtacgacgaccgccaggctgcgaatacgctgccctggggttcgcagttgtcggagcaaggtgtagcgacagcggttattccagataaggataagaggcaatgcactaacggcgattaaccagagaataaagttcagaccaacaacttcttttgacaggtcgatatcggtggtcatgacggaagcgatgatgccataaccaatgaccacattaaggaaggtcatgtaatagctggcacctgcggaaaagagcaccaccagcgatgccagaatacgccagctgcggcggccaaacagcgaaagaagacgtagtaaaaagaaggtcaccagtacggtggcggccagttcaacaacagcagaaatgcctttccagacggtaaaatcgtgcgcatagctgccgaagcggcggtaaaaaaccgcgccattcataaaaaggccaatatagattgcaagcaaaaagctcagcttctgctgtgtaatcgatttgatgtatctcatgcaaacaaaccctggacaaacaggtgataacaccctgcttagtggcttttcaggcccggcagggaaaaagtgcggaggtagtcagataagtaaaatctacacgcgcgaataagtagaccacagcaaagggaaaaagtgtggggaaagagtgtgcatgaagcacaaatttacaaaaatgcaagtttgaaaagagactttagcgttacaaaaagcagtaaaaagggccagttaattggcccaaattttacgagtcattgtttatacatttcgttgatgcgtttgatgcacacggaagctgaagcccagtagctcgcggctgagcattaaagggagccatgcgcctcacgcaacattttctgctctggctgacgaatcgtcgtagaaagcgccaatgacagaatcagcagggcgaaaatcacgtagaaggtcacatagaagccgccaaacagtgaggcgataatcgaaccacaaatgctaccgataccgaaaccgagataaatcacaccgtagtttttcgccaggttattgaggccaaagaactcactgaccagtgacggaaagacggtaatagtgccgccaaagttaaatgccacgcaggcaatcgctgcaaagaacgtcactgcattcaatggtgcaaacagcagggccgccatacccaccagcgatatcacctgaccaatggtaataacacggatacgggcgattttgtcagacagaatacccagcaccagacgacctgaaaggttggcgatggaaataacagtgactgcattggctgcggaaaccacatcaaggtgtgccagactttgggcgatatctttcgctaccccaatcacgtacaggccgctcatgcaggcggtcaggaacattaccgctaacatccagtactgcggtttacgcatcgactctgccagcgtgtaatctttctccaccacaccattgctggttttcacttcctgttttggtgcgtctttcattaacgttgcgccgaaaacaatcatcaacagcgcaatcgctccccaaatcacaaaggttttttccagaccgaccgtttccagcagctgcgtgtcgataaatttgaaacccaggctacccagaccataagaaccgatagcgaacgcggagatcagacctttacgctccgggaaccacttcacacagttagagagcgtcagcagataacccgcgccatctgccagtcccaccagcacaccggcgcttaaccacagcatcatcaggttgtcagaatgcgctgtcaggaagaagcctaatcccagcaaaatgccggaagccatggtgacgcgtttaacgccaaaacgttcctgtaatttgcccgcaacagaagacgaaattgccagccccagacttaacaagccgaaagagaaagcgacctggcttaccggcgcatccagcttggcggaaagcgcgccattaaacaggctccaggtataaaccgaccccagcgcaaactgggtaatgatagtaccgatgagtgtcagccagcgggtacgctgataatttgaaggtgtcatggcagtattcctgcagtaataaaaaggaaaaatctctgccgacaaccataacgaagtgcactttatgcctggggaaaaacggcatgaaatgccatcagaacggaatgaaatgccttagttcaggaatgaatgacgcgacaattattcaccaaatttattatttggtaagttagcacccactatcgccacaactattgttatttaatggtttcaattgtgactgttacgttaaaatctggcgctaacccccatcgtatacagatagtcgctattattagtggtattttctgcctgagttagcgcggcataggcggcaatattttgattgagcaacatatcagcgcctacggtgacatccagccagttgccgttctggtttgtcgccgtcatccggctcaggcctgattgcgccttccagatattctcgccaaattgctggttatagctgatttgcgcccagggtcggagatcgccaagccgggagtcaacacgccagcctaaggtactcacgctggcatgccataacggatcggtcagcgtggtagtactgtcgccaaactcgttatacatcgaggtggttgtgccatcgtaatgtaatgccgcgaccgggccggttgtaacctgttcatataaaggaaaattccagcccatactcatactgctggtcacatccacaggggtttcttccgccagattgacttccagtcccagcgccctttggctactttgaatacgttgcgacaaaatatcgttgtaatcaggttgatgatcactatcccaggtgtaacgctctgtggaaagtccgggttgcgtatcaacgatatattcttgttgccaggcgtaagctgtgttgagaaaaaaggcactgattaccacgctcgccagcaggcttagctgccagcgaccaccgcttttttttatgatcattaacacgactccagggaagagccgaattcggcaatattattgtcattgtatgaaggatatcgggcatagtagccctgtattaaatattgactttttcaccgatgcgtcaagaaaagcggctgaaatttttacgatcgggtacatagcgagggaaagtatggaacgttgcggctgggtgagtcaggacccgctttatattgcctaccatgataatgagtggggcgtgcctgaaactgacagtaaaaaactgttcgaaatgatctgccttgaagggcagcaggctggattatcgtggatcaccgtcctcaaaaaacgcgaaaactatcgcgcctgctttcatcagttcgatccggtgaaggtcgcagcaatgcaggaagaggatgtcgaaagactggtacaggacgccgggattatccgccatcgagggaaaattcaggcaattattggtaatgcgcgggcgtacctgcaaatggaacagaacggcgaaccgtttgtcgactttgtctggtcgtttgtaaatcatcagccacaggtgacacaagccacaacgttgagcgaaattcccacatctacgtccgcctccgacgccctatctaaggcactgaaaaaacgtggttttaagtttgtcggcaccacaatctgttactcctttatgcaggcatgtgggctggtgaatgatcatgtggttggctgctgttgctatccgggaaataaaccatgattcgggaagcgcaacgttcagaactccccgcgatcctcgaactgtggctggaaagtacaacctgggggcatccctttataaaagcgaattactggcgtgactgcattccgctggtgcgggatgcctatcttgccaacgcgcaaaactgggtctgggaagaagacggtaagcttctcggttttgtcagcattatggaaggccgatttctggcagcgatgtttgtcgcaccgaaggccgtcaggcgcggtattggtaaggcgctgatgcagtatgtgcagcagcgccatccccacctgatgctggaggtttatcaaaaaaatcaaccggcgataaatttttaccaggcacagggttttcacattgtcgattgcgcatggcaggatgaaacccaactacccacatggattatgagctggccggtggttcaaacgctgtaagtgtcagttccggaccgttgtatttttccagccatgccagcgccgtattacccgcacagccattccccagccgcgagctggggagatctttggtcagcacgttcactgcgccgtttttacaaataccgtcagcggttaaatccagatccggccatgccccttcgtgaatgcaaatcacgccaggtttaattccctcgctaatgaccgctccggcaagaatttgcccgcgtgcgttccacaaccgaacagtatcgccatcttgtatgccgcgctcctgggcatcgtcaggatgaatggtgacaggctcacgatttgccaccgcgtacaattcgcgcagagaactgtaattcagctggctgtgcaggcggtgcgccggatgggcagaaagtacctgcaactgttctggttcggcattgccctgccattcgtccggctccagccacattggatgcccagggcaatccgggtaaccgtaatcggcaatacgctgtgagaagatttcaatcttgccgctggcggtttttaacggatgcgccagcggatcgcggcaaaaatcagcgaagcgaataaaccgctcgctgtccgggttttccggcatctcaattaactggttggcttgccagaactcagcaaatggcggcaattcaacctgctggcttgccccgcgctgtcgggcaacgttataaaacgtttccagccattgcagctcactttttccttccgtaaaacgtgcataaccgcccttctcccagcgttcacttaactcggcaaaaacatcaaaatcattacgcgcttcatagcgtggcggcaccacttgcttcatcggcaccagatgctgattactgtaatcaccggtcatggtgagatcattacgctcaaaagaggtagtcgcaggcagaacgatatccgcgtgttttgccgccgccgtccagaagcattcagagatcaccaccagctccggtttttgccaggcacggatcaggcgattggtatcctgatgatgagtaaagttggcaccgcccgcccaccagataaaacgaatatccgggaaatgtcggttcataccgttgtgttgatatgcgccaccagggttttccagtgcttcaacaatgcgggcaacagggattttatccaccgcatcgcagccacccggcaagctgccctgcatggaagagagcaccgcagaacgccgcgtggggttaccaccattggcaaaatggtaagaaagaccaaaaccgccgccgggtgtgccgatttgccccaacattgctgccagcgtgacgatcatccagtgtttttgctcaccaaactgttggcgctgcattccccagcctgccatcagcatggtggtattttggtggaaaatagccgccagctcgcggattttcgctgcgccaacaccacaaatctctgctgcccattcggcggttttcgctattccgtcactctcgcccagcaaataagaggcgaagacggcataacctgtggtgcaacgcgccagaaacgcttcgtcgtgccaaccattttccaccagcgtatgggcgatccccagcatcagcgcaacatcggtgcccatgtgcggtgccacccactccattttatcgccaaagaaatcgacggtttccgatcgcattggatcaatgcagatcagctttttcccgctgtcacgcagtgcagaaaagtaagaaagcccctgctcatcggatgcattccacgcaattttcagcgtattgagtgggttagcactccacagcaccacgacatcgctatgttccagcaccagcggccaactggtctgctgttgataaacttcactaccacccacgacatacggcatgatcgcctgtgccgcgccggtcgaataatcccccagatgcccggtataaccgcctgccagcgccatatagcgttgtaataatgtcgaggccttatgcagcacgccgtttgaacgccagccgtaggaaccagcaaaaatcgatgccggaccataagcctcacgaatgcgtttatgttgttggtgaataagatccagcgcctcatcccaactcacgcgaacaaattcatcctgcccacgaatgccttgcgggttttccggtgacgcaagaaagccttttcgcaccattggaaatcgtacccgcgtattgctgtgaacctggtcgcgaaccgcgctctgcaaggagttttccattcctgtggctaacgcgccacgcgagctaaacacggtttcgccgtcggtttcaaccagcatgggcccccaatgggcggcagtcagaacggaatatcgtgaggatgagttggccaaaccgaagactcctgaaaggttagatgtattgagcagttaaatattacttacaaatttccgagtattcccaggaataatcttcatgttcacgcggcataatctcccgccacggaacccgtggcaaagaataaaaaggttattaaggattaacaatgaagaaacgtgtttatcttattgccgccgtagtgagtggcgctctggcggtatctggctgcacaactaacccttacaccggcgaacgcgaagcaggtaaatctgctatcggcgcaggtctgggctctctcgtgggcgcgggtattggtgcgctctcttcttcgaagaaagatcgcggtaaaggcgcgctgattggcgcagcagcaggcgcagctctgggcggcggcgttggttattacatggatgtgcaggaagcgaagctgcgcgacaaaatgcgcggcactggtgttagcgtaacccgcagcggggataacattatcctcaatatgccgaacaatgtgaccttcgacagcagcagcgcgaccctgaaaccggcgggcgctaacaccctgaccggcgtggcaatggtactgaaagagtatccgaaaacggcggttaacgtgattggttataccgacagcacgggtggtcacgacctgaacatgcgtctctcccagcaacgtgcggattccgttgccagcgcgttgatcacccagggcgtggacgccagccgcatccgtactcagggccttggcccggctaacccaatcgccagcaacagcaccgcagaaggtaaggcgcaaaaccgccgtgtagaaattaccttaagcccgctgtaatccctttcatgccaggtgatgcagaaatcacctggcattcttcagttttccttcatcatatttcaggctaaggtgatcgccttatcagtgaatggagagaagcatgaagccgtccgttatcctctacaaagccttacctgatgatttactgcaacgcctgcaagagcatttcaccgttcaccaggtggcaaacctcagcccacaaaccgtcgaacaaaatgcagcaatttttgccgaagctgaaggtttactgggttcaaacgagaatgtaaatgccgcattgctggaaaaaatgccgaaactgcgtgccacatcaacgatctccgtcggctatgacaattttgatgtcgatgcgcttaccgcccgaaaaattctgctgatgcacacgccaaccgtattaacagaaaccgtcgccgatacgctgatggcgctggtgttgtctaccgctcgtcgggttgtggaggtagcagaacgggtaaaagcaggcgaatggaccgcgagcataggcccggactggtacggcactgacgttcaccataaaacactgggcattgtcgggatgggacggatcggcatggcgctggcacaacgtgcgcactttggcttcaacatgcccatcctctataacgcgcgccgccaccataaagaagcagaagaacgcttcaacgcccgctactgcgatttggatactctgttacaagagtcagatttcgtttgcctgatcctgccgttaactgatgagacgcatcatctgtttggcgcagaacaattcgccaaaatgaaatcctccgccattttcattaatgccggacgtggcccggtggttgacgaaaatgcactgatcgcagcattgcagaaaggcgaaattcacgctgccgggctggatgtcttcgaacaagagccactgtccgtagattcgccgttgctctcaatggccaacgtcgtcgcagtaccgcatattggatctgccacccatgagacgcgttatggcatggccgcctgtgccgtggataatttgattgatgcgttacaaggaaaggttgagaagaactgtgtgaatccgcacgtcgcggactaagccgcgactgcgtagagtaaagcccgataatcgctcgggcttttactctttattgggttgcagtaactgctgtagtccaggcctgattaaacgcctgatgctgtgccggtaatggcgcaatcagtttgttatattcacttgcctgctgtgaagtcgggaactggatgccatttgcgacaaagctcacctgagtaccttgctgagcaatgtagtctccaaccatcaccagttgttgcgtgaaagtttgtgccgccggaatcaacggttgcaatgcatcagctggcgtcgttaccactttggtgaatgcctgatcaaagaccggtttcaaatcatcgctctgttttagcgcagagtgcgcagcatcggcctgcaacttcgcattttgcagttgttgcgccagcacacccagcgaaccgttcatttcacgcagcggaccgctttgcgtaacgtaatcctgcggtacgcgaattgcgttaacgctgtctacaaccgggcgcagaccggaatccatcgcctgattcacctgctgagaataaccatacagaatcgcgtaatcagagacaaaaggaccaaactgttttttctgatcggcagtcagggttggtagacgttcaccgctacgcatcactgtattctgcaggaagtcgataaacgctttacgctgatcgccttctttatcaaaacacccactcaggctaactaccattaataacgccgcaagaggcgcaaaccagcgagagcaggactttcctgtcgccattttcttactcctttcacccaaaaaaagcgcacaacgacacacgcgtgtctgacgtgacaaggatagtccaggacaggcttgcaggataccctttctacgtaatcttcctggtaaaatcatggagaaaatgaaacaaggttaatttgttgtttcattgttaaaaaatgatagtgccgttgccttttttgtagccagagatttacgccttcgcagaaggttagattttcgaaatctttacaaaacaggagtggtaagagatatatcggcatttatcagatcgttaggtggctataagtcacgctaaatgacaggctgaatcgaatcatagccagagcatgccctgacttcaccccgctgtgtctgcttttcccgactattcttaatgagcttcgatgcaattcacgatcccgcagtgtgatttgaggagttttcaatggaatataaagatccaatgcatgagctgttgagcagcctggaacagattgtttttaaagatgaaacgcagaaaattaccctgacgcacagaacaacgtcctgtaccgaaattgagcagttacgaaaagggacaggattaaaaatcgatgatttcgcccgggttttgggcgtatcagtcgccatggtaaaggaatgggaatccagacgcgtgaagccttcaagtgccgaactaaaattgatgcgtttgattcaagccaacccggcattaagtaagcagttgatggaatagacttttatccactttattgctgtttacggtcctgatgacaggaccgttttccaaccgattaatcataaatatgaaaaataattgttgcatcacccgccaatgcgtggcttaatgcacatcaacggtttgacgtacagaccattaaagcagtgtagtaaggcaagtcccttcaagagttatcgttgatacccctcgtagtgcacattcctttaacgcttcaaaatctgtaaagcacgccatatcgccgaaaggcacacttaattattaaaggtaatacactatgtccggtaaaatgactggtatcgtaaaatggttcaacgctgacaaaggcttcggcttcatcactcctgacgatggctctaaagatgtgttcgtacacttctctgctatccagaacgatggttacaaatctctggacgaaggtcagaaagtgtccttcaccatcgaaagcggcgctaaaggcccggcagctggtaacgtaaccagcctgtaatctctgcttaaaagcacagaatctaagatccctgccatttggcggggatttttttatttgttttcaggaaataaataatcgatcgcgtaataaaatctattattatttttgtgaagaataaatttgggtgcaatgagaatgcgcaacgccgtaagtaaggcgggaataatttcccgccgaagactcttactctttcaatttgcaggctaaaaacgccgccagctcataactctcctgtttaatatgcaattcacacagtgaatctcttatcatccaggtgaaaaataaaagcgtgaaacaaatcactattaaagaaagtaatctatatttctgcggcattcccagcctcctgtgttgatttccaacgagtatgtactgcacccattttgttggacgatgaaatggaatagcccctaatatgtcaaagccaaaatacccttttgaaaagcgccttgaagtcgtgaatcactacttcacaactgatgatggttacaggatcatctcggcacgttttggtgtcccccgaacccaggtcaggacatgggttgccctctatgaaaaacatggagaaaaaggtttaattcccaaacctaaaggcgttagtgctgatccagagttgcgtattaaggtcgtgaaagctgtgatcgagcagcacatgtcccttaatcaggctgctgctcactttatgcttgctggtagtggttctgtagccaggtggctgaaggtctatgaagagcgcggagaagctggtttacgcgcgctcaagattggcaccaaaagaaacattgcaatatcagttgatccagaaaaagcggcatcagcattggagctgtcaaaagaccgacgcattgaggatcttgaaaggcaagttcgatttcttgaaacgcggcttatgtatctaaaaaagctgaaagccttagctcatcccacgaaaaagtgaaagtactcaacgagctaaggcagttttatcctcttgatgagcttctcagggctgcggagataccgcgcagtacgttttattatcatctaaaggctctcagcaagcctgacaagtatgcggacgttaaaaagcgtattagtgagatttatcacgagaatagaggccgatacggataccgtagggtaacgctgtctcttcatcgagaagggaaacagattaaccataaagctgttcagcgcctgatgggaaccctctcacttaaagcagcgattaaggtcaagcgataccgctcttacagaggagaggtagggcaaaccgcccctaatgttctccaaagagatttcaaggctacgcggccaaacgagaagtgggttaccgatgttactgaatttgcagtcaatgggcgcaagctgtatttgtctccagtaatagatctcttcaacaacgaagttatttcttacagcctttcggaaagaccagtgatgaacatggttgagaatatgctcgatcaggcattcaaaaagcttaatcctcacgagcatcctgttctgcactctgaccagggatggcagtatcgtatgagaagatatcaaaatatccttaaagaacatggtattaaacaaagcatgtccagaaaaggcaattgtctggataatgctgtggtggagtgtttctttggaaccttaaagtcggagtgtttttatcttgatgagttcagtaatataagcgaactgaaggatgctgttacggaatatattgaatactacaacagcagaagaattagcctgaaattaaaaggtctgactccaattgaatatcggaatcagacctatatgcctcgtgtttaactgtccaactttttggggtcagtacaaactttgatttatagtcaggtggggcttttctctgtctgcctttcggtgaatacctgagacaaacagtctcaagcacccgtggctattctagcttaataagtttgtttcttctccttgatataatcctaaaaaaatctcataaaattaatatatgagataatctttattcagcagaagattattaaaggttgctgtattatttagcgataaaaaaagcctgccagatggcaggctatttaataacggcgttattattgcaacagcgaaatatccgcaacgcgcaggaacagttcgcgcagtttctccagcatggtcagacggttgatacgcaattctttgtcatcaaccatgaccatcactttatcgaagaaagcatcaaccggttcacgcagctcagccagttcgaccagcgcatcctggtaacgaccttccgtaaagtacggctccagcttgtcacgtagcaccacaacctgcatcgccagtttaatttcttccggctctttcagggtagaggcattcacgcggtcgctcagcacttcgtcagatttcgccagaatgttagatacacgtttgttcgccgccgccagtgcagcagctgcatccagggtacggaaatgcgataccgctttcatacgggcatcgaaatcagccggacgagtcggacgacgcgccagtaccgcctggatggtgtcaacggtataaccttcgtcctgataccaggcgcggaagcgaccgagcataaagtcgataacatcatcaactacgttggcattagtcagcttatcgccatacagacgcaccgcttcttcggtcagcgtttgcagatcaaggttgaggttcttctcaacgataattcgcagcacgccaagcgcggcacgacgcagcgcaaacgggtctttgtcgcctttcggatgctgaccgataccgaagatacccgccagggtatccatcttgtcagcaatcgccagcgcacaagctactgggttggacggcaggtcatcaccagcaaaacgcggctgatactgctcattcagcgccaccgcgacatcttccgcttcgccatcgtgacgcgcatagtgcatccccataacgccctgggtgtcggtgaactcgaagaccatgttggtcatcaggtcgcacttagacagcagacccgcacgggtagcgtggttaacgtcagcgccaatctgttcagcaatccagccagccagcgcctggatgcggtcagttttgtcgcgcagcgtccccaactgttgctggaacaacacggtttgcaggcgcggcaggttatcttcaagacgttttttacggtcggtgttgaagaagaactcggcatccgccagacgcggacgaacgactttctcgttaccggagataatctgctgcggatctttcgattcgatgttggcaacgaagataaagttcggcagcagtttgccgtcgttcgcatacaccgggaagtatttctggtcacctttcatggtgtaaaccagcgcttcagccggcaccgcgaggaatttctcttcgaattttgcggtcagaacgaccggccactccaccagcgaagccacttcttccagcaggctttcgcttaagtcagcgttaccgccaatcttacgcgctgcttcttcggcatcggctttaatcttcgccttacgttcttcgtaatcggcgatgactttcccacgctcacgcagaatttccggatactgatcggcgttatcgatggtgaattccggctcgcccataaagcggtggccgcgaatcacgcgatcggactgaatgcccagaatggttgccggaatgactttgtcgcccagcagcagggtcacggtgtgcaccggacgcacgaagtgcacgtcgcttgcgccccaacgcatcagtttcgggatcggcagtttcgccagagaagtcgcaaccatattcggcagcagtgcttcggtgctttcgcccttcacatgggcgcgatacagcagccattcgcctttatcggtagtcagacgctcagcctggtcaacggtaataccgcaaccacgcgcccaaccttctgccgctttgctcggtttgccttcagcgtcgaacgcctgggcaatcgccgggccgcgtttttcgatttcacgatccggttgcgcttccgccaggttagctactttcagcgccagacgacgcggagcagcaaaccattgaacggtgccgtgtgcgaggccagcgttatccagctccgcagtaaagttcgcagcaaaggactcagccaggctgcgcagtgcttttggtggcagctcttcagtgccgatttccaccagaaaagttttctcagacatagccgcctcttacttatctttgttgcacatcgggaagccgagggcttcacgggaagcgtagtatgcttctgccactgctttggtcagggtgcgaatgcgcagaatgtagcgctgacgctcggtgacggagatggctttacgcgcatccagcaggttgaagctgtgggcggctttcagaatacgctcgtaggctggcagcggcagcggattttccagcgccagcagctgctgcgcttctttctcgtactgctcgaagcaggtgaacaggaagtccacatccgcgtattcgaagttgtaagtggactgctccacttcgttctgatggaacacgtcgccgtaggtggttttacccagcgggccgtcgctccagaccaggtcgtaaacgctgtctacgccctgaatgtacatggccagacgttccagaccgtaggtgatctcgccggtaaccggtttacactccagaccaccaacctgctggaagtaagtgaactgcgtcacttccatgccgttcagccacacttcccagcccagtccccaggcacccagcgtcgggttttcccagttatcttccacgaaacggatgtcgtgaatagtcgggtccatgcccagctctttcagagaaccgaggtacagctcctgaatattgtccggcgatggcttaatgaccacctggaactgatagtagtgctgtaaacggttggggttttcgccgtagcgaccatcggtcgggcgacgagaaggctgaacataagcagccgccatcggttctggccccagctcgcgcagacaggtcattgggtgagaggttcccgcgccgacttccatgtccaatggttgaacaatggtgcagccctggcgagcccagtaatcctgtaaggtcaggatcaagccctggaaggtcctggtatcaaacttttgcatattatttcgtgctggatacgtgtggatttaaaggaagggatcagtatacccgctggatggaagatatacagtacgaaacgggaaaaagcagggcttaacgcatggaaagatgcaaaaaatggccatccgcgtcaaaagaacagacaaactgctctttacggaaggtataaccgcgcatttcatagcttccctggaactgttcgaaggcggtgacgtcgattttttgctcgccggtgttataacgttttgccgcctgatccttgcataacgcttccatattcaacgaacgcagaggatcaacctttacccgttgtgctttctgcacgggtgacggtatagaacaacccactagcaccataagcgccattgccggaaagaaagcgttcatcatcattaaattaccgtctggtttgcaggtgagtcttattatttatatcggtatagtggctgatatcttacgaatttccttaagcctctataagctgtagtgataaaactcagattattccagtgcgccaaccaaatgatttatcggtcagactttttttaaccagatacagagacacagatgcagcccaaaatttactggattgataacctgcgagggatagcgtgtttaatggtggtgatgattcacaccactacctggtatgtgaccaatgctcatagtgttagccccgtcacatgggatatcgccaatgttctgaattctgcctctcgtgtcagcgtgccgctatttttcatgatttccggctatctcttttttggcgaacgcagcgcccagccgcgccatttcttgcgtatcggcttatgtctgattttttatagcgcaatcgcactgctctacattgcgctgtttacctccatcaatatggagttagcgctgaaaaacctgctgcaaaagccagtgttttaccacttgtggtttttcttcgcgattgcggtgatttatctggtttcaccgctgattcaggtgaagaacgtcggcggaaaaatgttgctggtgctaatggcggtgattggcattatcgctaacccaaacacagtgccgcagaaaattgacggttttgaatggctgccaattaacttatatatcaatggcgatactttttactacattctgtatggcatgttgggccgcgctatagggatgatggacacacagcataaagcactgtcgtgggtgagcgccgcgctgtttgcgacgggggtttttattatctctcgcgggacattatatgaattgcagtggcgcggaaattttgccgatacctggtatctttactgtgggccgatggtttttatctgcgcaatcgcgctattgactctggttaaaaacacgctggatacgcgtaccattcgcggacttggcttaatctcccgccattcattgggtatatacggattccacgccttgattatccatgcgctgcgcacccggggaattgagcttaaaaattggccaatactggatattatttggatcttttgcgcgacgttggcagcgagtttgttactttctatgctggtacaacgaatcgacagaaacagattagtgagttaagtaaaagcccggtcacattggactgaccgggcttacgtgagttattcgctgtattcttcctgggtaacctgtgtttcttttggtgggtttattccggcatcacgaatatttttctgcaccgctactgcaccaaacaagcttaagaagaaagccagtccataaaaacctttttcgctgagtaataatgtcgcattccacagacctaccatcagtaatgcaacagagataataaagacagtcaggcaggtcatataataaatggaagtggtcggtatgccttcatacttgtcccgaacggtcttttgataagacgccgcagaaaacagtcctaataccagtacggcaaaataatatcctttttcatttaactgcatctctgcattccatagccctaacagataggtaacgataccaccaacgagagctatccatgacacaatactaaaggccggtgaataggttgatattttgttgtccatcacagtattcctttcattcctgaatatgtaagagctttatgttgctcatgccgagcgaaacaaacgcatttgaccaaacaagcagacaaaaaaggcgatgggatagatcaccatttcataagtattgataggtgcgtttaaaacaccgataaacaagagaccgatagtgattaacgcaactaactggcagatatgggtaaaaaaatcatccagttgcccgagtttttctgcgcgaagatatgcatagttgccaaaagttgctgtcattaacacgccaagaaaatagccttttccacttaacaatgggcatgagatccatagcccaaccagataaaccagcgccccgacaacaaataatagttttgccacagtctttgaggttttcataacgatctccatatctaccagcgatacattacgagtaaccaacgaaagacaaaactgaaaaatgccattaacaaatgattttcagaataaattcatactaaatattaattaattactgagatatatagatgtgaattatcccccacccggtcaggcaggggataacgtttacgccattaatggcagaagttgctgatagaggcgacggaacgtttctcgtcgtggctgataagcggcataacgctgcgcatctggtagatgcgactgttctaacggtagttgcggcaacaattcaatgagcgatttctctggattcgccgcgatctgcgccagccttgctgcgcccagtgctggccccacatccccccccgtacggtaatcgagctgctgaccgctgatatccgccagcatctgacgccagtactcactacgcgccccgcccccaatcaacgtaacactttgcggtttaataccgcaggcatgcacgacatccatgccatctgccagcgcataacccacgccttccagcactgctcgcgccagttcattggggccatgttgatgagtcaaaccaaagaaaacccccttcgcctggggattattgtgtggcgtacgctcgccggaaagataaggcagaaaccaaactggctcggcactttcatcagcctgttgagctgcagcgattaaagctgggacattgctcaggccggttaatttcgcggcccaatccagacacgacgctgcactcagcatcacagacattaaatgccaacgttgcggtagcgcatggcaaaagctatgtacggcgctttctggcttgcttaagaacccttcgctgacagcaaaatagacccccgacgtccccagcgataacattgcctgattagcatcaaccattcccacaccaactgcaccagctgcattgtcgccaccgcctgcgacaactggcaccgtcgccataccccacgctttcgcaacttcaggtaacaaagcaccagtaatttcgctgccttcgtataatgcgggcatctggtcacgagataagtcgcaagcctgcagcatgacgtcactccagtcacgctttgcgacatccagccacatggtgccagctgcgtcagacatatcgctggcaaactcccccgtcatacgcagacgcaagtaatctttcggtaataatactttgtcgatttgacggaatatctccggctcatgccgctgaacccatagcaatttaggcgcagtaaatccgggcatcatcaggttgccggtaatcacccgcgattgcggaactcgcgcttccagcaaagtgcactcttgcgcacagcgcccgtcgttccacaaaatggcagggcgtaacacccgttgctgagcatccagcaaggttgctccgtgcatctggccggcaatacccaatgctttaacgtcctgcagagaatgctgatcgcccagagctttcattgcgcgatcagttgcctgccaccactgttccgggtcttgttccgaccagagtggatgcgggcgcgaaacggtcagcttttccgtttgcgcagcaaccacctcaccctgctcgttgagcaaaataacttttacgcccgaggtgccaagatctatcccgatatacatatcgatcgttccttaaaaaaatgcccggtatcgctaccgataaccgggccaacggactgcacagttagccgttatttgtcgaacagataatggtttaccagattttccagttgttcctggcgaccactctgatgcaccggagacaaatgatgttcctgagcatatttggctaaatctgccagtgacatttggcctttcaggatttgctggcccaattcgctattccagccggaataacgctgcgcgatgcgtttatccagctcgccatcttcaatcatgcgcgctgcaattttcagcgccagtgccatcgtatccatcgcgccgatatgaccgtaaaacagatcatatttatcagtactttgacgacgtactttggcatcgaagttcagaccaccggtggtgaaaccgcctgctttgagaatttcatacatcaccagcgcattctcttccacactgttcgggaactggtcggtgtcccagcccagttgcgcatcgccacggttggcgtcgacagaaccgaacaggccaagcgcaatggcggtggctatttcatgatggaaagagtgacctgccagcgtcgcgtggttagcttcaatgttcagtttaatctctttttccagaccaaactgtttcaggaagccatagaccgtcgcggcatcgtaatcatattgatgtttggtcggttcttgcggtttcggttcgataagcaacgtgccctggaaaccgattttatgtttatgctcaaccaccatctgcataaagcggcccagttgttcacgctcctgacgcaagtcggtatttaacagcgtttcgtaaccttcacgaccgccccacaggacatagttttcaccgcccaatttatgggttgcttccatcgctgtaacaacttgcgttgccgcccagctgaagacttcaggatctgggttcgtcgccgcacccgcgccgtagcgagggtttgtaaagcagttggccgttccccacagcagcttcacgccgctctcttcttgcttgcctgccaggacatcaaccatttgcgcaaaattattgatgtactcttttaacgacgcgccctcaggggaaacatccacatcgtggaagcaataaaatggcacatgtaacttgtggaaaaactcaaatgcgacatctgctttacgcttcgccaacgccagtgcctcaccaggctgctgccacggacgattaaacgcccccacaccaaacatatccgccccgttccagcagaaggtgtgccagtagcaggcggcaaaacgcaagtgctcttccatacgcttacccaacaccagttcgtcgggattgtagtgacggaatgctaacgggtttgaggattttgagccttcataacgaacgcgatcgagctggtcaaaataggcttgcatattgaactccataatcaggtaatgccgcgggtgatggatgatgtcgtaatattgggcactccctttcagttgctcaattatgttatttcacactgctattgagataattcacaagtgtgcgctcgctcgcaaaataaaatggaatgatgaaactgggtaattcctcgaagagaaaaatgcaataagtacaattgcgcaacaaaagtaagatctcggtcataaatcaagaaataaaccaaaaatcgtaatcgaaagataaaaatctgtaattgttttcccctgtttagttgctaaaaattggttacgtttatcgcggtgattgttacttattaaaactgtcctctaactacagaaggccctacaccatgaaaataaagaacattctactcaccctttgcacctcactcctgcttaccaacgttgctgcacacgccaaagaagtcaaaataggtatggcgattgatgatctccgtcttgaacgctggcaaaaagatcgagatatctttgtgaaaaaggcagaatctctcggcgcgaaagtatttgtacagtctgcaaatggcaatgaagaaacacaaatgtcgcagattgaaaacatgataaaccggggtgtcgatgttcttgtcattattccgtataacggtcaggtattaagtaacgttgtaaaagaagccaaacaagaaggcattaaagtattagcttacgaccgtatgattaacgatgcggatatcgatttttatatttctttcgataacgaaaaagtcggtgaactgcaggcaaaagccctggtcgatattgttccgcaaggtaattacttcctgatgggcggctcgccggtagataacaacgccaagctgttccgcgccggacaaatgaaagtgttaaaaccttacgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggtggggcaattcaggcattaagcgcgcaaggtttatcagggaaagtagcaatctccggccaggatgcggatctcgcaggtattaaacgtattgctgccggtacgcaaactatgacggtgtataaacctattacgttgttggcaaatactgccgcagaaattgccgttgagttgggcaatggtcaggaaccaaaagcagataccacactgaataatggcctgaaagatgtcccctcccgcctcctgacaccgatcgatgtgaataaaaacaacatcaaagatacggtaattaaagacggattccacaaagagagcgagctgtaagcgttacgccccagcgcggagcgggggcgtgatttctctccatgccgcgtgaatgaattggcttaggtggagtcgttatgccttatctacttgaaatgaagaacattaccaaaaccttcggcagtgtgaaggcgattgataacgtctgcttgcggttgaatgctggcgaaatcgtctcactttgtggggaaaatgggtctggtaaatcaacgctgatgaaagtgctgtgtggtatttatccccatggctcctacgaaggcgaaattatttttgcgggagaagagattcaggcgagtcacatccgcgataccgaacgcaaaggtatcgccatcattcatcaggaattggccctggtgaaagaattgaccgtgctggaaaatatcttcctgggtaacgaaataacccacaatggcattatggattatgacctgatgacgctacgctgtcagaagctgctcgcacaggtcagtttatccatttcacctgatacccgcgttggcgatttagggcttgggcaacaacaactggttgaaattgccaaggcacttaataaacaggtgcgcttgttaattctcgatgaaccgacagcctcattaactgagcaggaaacgtcgattttactggatattattcgcgatctacaacagcacggtatcgcctgtatttatatttcgcacaaactcaacgaagtcaaagcgatttccgatacgatttgcgttattcgcgacggacagcacattggtacgcgtgatgctgccggaatgagtgaagacgatattatcaccatgatggtcgggcgagagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatattgggtattgccggactcgttggtgccggacgtaccgagaccattcagtgcctgtttggtgtgtggcccggacaatgggaaggaaaaatttatattgatggcaaacaggtagatattcgtaactgtcagcaagccatcgcccaggggattgcgatggtccccgaagacagaaagcgcgacggcatcgttccggtaatggcggttggtaaaaatattaccctcgccgcactcaataaatttaccggtggcattagccagcttgatgacgcggcagagcaaaaatgtattctggaatcaatccagcaactcaaagttaaaacgtcgtcccccgaccttgctattggacgtttgagcggcggcaatcagcaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctgaagtgaaattggccgtaccgacatccggtggcttctccgggctgaaatcactgaatttgcaggtcttcgtgatgattgcagctatcatcgcaatcatgctgttctttacctggaccaccgatggtgcctacttaagcgcccgtaacgtctccaacctgttacgccagaccgcgattaccggcatcctcgcggtaggaatggtgttcgtcataatttctgctgaaatcgacctttccgtcggctcaatgatggggctgttaggtggcgtcgcggcgatttgtgacgtctggttaggctggcctttgccacttaccatcattgtgacgctggttctgggactgcttctcggtgcctggaacggatggtgggtcgcgtaccgtaaagtcccttcatttattgtcaccctcgcgggcatgttggcatttcgcggcatactcattggcatcaccaacggcacgactgtatcccccaccagcgccgcgatgtcacaaattgggcaaagctatctccccgccagtaccggcttcatcattggcgcgcttggcttaatggcttttgttggttggcaatggcgcggaagaatgcgccgtcaggctttgggtttacagtctccggcctctaccgcagtagtcggtcgccaggctttaaccgctatcatcgtattaggcgcaatctggctgttgaatgattaccgtggcgttcccactcctgttctgctgctgacgttgctgttactcggcggaatgtttatggcaacgcggacggcatttggacgacgcatttatgccatcggcggcaatctggaagcagcacgtctctccgggattaacgttgaacgcaccaaacttgccgtgttcgcgattaacggattaatggtagccatcgccggattaatccttagttctcgacttggcgctggttcaccttctgcgggaaatatcgccgaactggacgcaattgcagcatgcgtgattggcggcaccagcctggctggcggtgtgggaagcgttgccggagcagtaatgggggcatttatcatggcttcactggataacggcatgagtatgatggatgtaccgaccttctggcagtatatcgttaaaggtgcgattctgttgctggcagtatggatggactccgcaaccaaacgccgttcttgattttgataaaaattttctcaaagccggttacgtattaccggttttgagtttttgcatgattcagcaggaaaagaaccatgtttactaaacgtcaccgcatcacattactgttcaatgccaataaagcctatgaccggcaggtagtagaaggcgtaggggaatatttacaggcgtcacaatcggaatgggatattttcattgaagaagatttccgcgcccgcattgataaaatcaaggactggttaggagatggcgtcattgccgacttcgacgacaaacagatcgagcaagcgctggctgatgtcgacgtccccattgttggggttggcggctcgtatcaccttgcagaaagttacccacccgttcattacattgccaccgataactatgcgctggttgaaagcgcatttttgcatttaaaagagaaaggcgttaaccgctttgctttttatggtcttccggaatcaagcggcaaacgttgggccactgagcgcgaatatgcatttcgtcagcttgtcgccgaagaaaagtatcgcggagtggtttatcaggggttagaaaccgcgccagagaactggcaacacgcgcaaaatcggctggcagactggctacaaacgctaccaccgcaaaccgggattattgccgttactgacgcccgagcgcggcatattctgcaagtatgtgaacatctacatattcccgtaccggaaaaattatgcgtgattggcatcgataacgaagaactgacccgctatctgtcgcgtgtcgccctttcttcggtcgctcagggcgcgcggcaaatgggctatcaggcggcaaaactgttgcatcgattattagataaagaagaaatgccgctacagcgaattttggtcccaccagttcgcgtcattgaacggcgctcaacagattatcgctcgctgaccgatcccgccgttattcaggccatgcattacattcgtaatcacgcctgtaaagggattaaagtggatcaggtactggatgcggtcgggatctcgcgctccaatcttgagaagcgttttaaagaagaggtgggtgaaaccatccatgccatgattcatgccgagaagctggagaaagcgcgcagtctgctgatttcaaccaccttgtcgatcaatgagatatcgcaaatgtgcggttatccatcgctgcaatatttctactctgtttttaaaaaagcatatgacacgacgccaaaagagtatcgcgatgtaaatagcgaggtcatgttgtagcgatgatgagaattgtcggcgtcacatcaggtaacgctgcgtggttgtcggatgcggcgtgaacgccttatccgacctacccgccaggcatgataaaacgcaccaacaacgcttcaggctcgtagctcaactgcctgagacaaagtaaaaagccttatccgactgacaagtcggataaggctcaaggaaatgcaattacatatgcgccgcgattaaccgttggttatcctggtacattgcgaacaggtagttgttataactcttccctttggtcgagtagcccttcagcttgtgaatcatcgctgtggcagtcacttcctgatccgctttacgcagctgcgcacgcgatttacggaacgaagagtaagccgggtgcgtattcaggttagtgacataggcgctcaccgattctttgacagaactaaactgtgagtaccctttcactttacctggcgcattggtacaacgtcctttcatgcatttcatgccgaacaggttgttgttgttgcgcgccagcttcgacgttccccaaccgctttctgctgcagccatcgtcgccaccatactggtggggataatgtctacgcgttcaagcaaggtattccacgggatttttcgcgtattaccggaccacttcaccttgtagcgtttggcgatgtctttcagacgcgcacgctcagcaggtgaccattggccctgatactgttttgaaatgagccagttacgttccgcagtaatggccgcattttggctggtaatgtaaggcattacggtccggagaaacgcctttttccttggtgttccggaagggtattttcgcaaatcaggaagtgaactactctttgcactattgcgagaatactcttgtttactgcttacctgtttattactagctttagttaagtgggacttttgactcgctgttgttgtgtgcgtcttcgctaacacctcactcgaaaacaccagagtgagtaacataagaatcatcgccccatatcgtcgtatgggagtcaaaatcatcaggtctcctggtcggatttaatcattccaacaccttatatttttcacaaatttgagagttgaatctcaaatcatatcaaaaatagctgtcaagagcaccccaaggaatagtccaaatctgaaactatgtcacgtgttaacgattcagattggcgctaaatcgcagaaaatgtgggggttatcgcaaaattcagccgttttttgcgcgagatcgctcacccttgcttctcatcctgtggacttaccgctcagggatgagttttgtttggcttatcgctggcaaactgtctgaaatcgcagcaataaggactcatccgccatgaaactcgccgcctgttttctgacactccttcctggcttcgccgttgccgccagctggacttctccggggtttcccgcctttagcgaacaggggacaggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccgcctcaatggcgattgttcagggacggcgaatatacgctgcaaatagacacccgctccggtacgccaacattgatgatttccatccagaacgccgccgaaccggtagcaagcctggtccgtgaatgcccgaaatgggatggattaccgctcacagtggatgtcagcgccactttcccggaaggagccgccgtacgggattattacagccagcaaattgcgatagtgaagaacggtcaaataatgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaatcgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctagcctttttgccggatatcaaaaccgaatcaactaccgcttctggtctgccggtgttctataaaaacaaaatggatacccacgccaaagccattgacggctatacgccgcgcgattacttaacccactggttaagtcagtgggtccgcgactatgggattgatggttttcgggtcgataccgccaaacatgttgagttgcccgcctggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgactgtctggcgcagatggatacgacctggcagcaaatggcggagaaattgcagggtttcaacgtgttgagctacctctcgtcgcatgatacccgcctgttccgtgaagggggcgacaaagcagcagagttattactattagcgccaggcgcggtacaaatcttttatggtgatgaatcctcgcgtccgttcggtcctacaggttctgatccgctgcaaggtacacgttcggatatgaactggcaggatgttagcggtaaatctgccgccagcgtcgcgcactggcagaaaatcagccagttccgcgcccgccatcccgcaattggcgcgggcaaacaaacgacacttttgctgaagcagggctacggctttgttcgtgagcatggcgacgataaagtgctggtcgtctgggcagggcaacagtaacttttccggcttcccgttcgtcagtacctcgggaagccgccaaccaggataaaatgtcagccctaatcagcgttgcaggataaagcaccgctcactcttcaacagaccgatttgcaccccagcaaatgtagcgttattgttaccttccttgctacagagttcgacagatatcccgctatgacattctccctttttggtgacaaatttacccgccactccggcattacgctgttgatggaagatctgaacgacggtttacgcacgcctggcgcgattatgctcggcggcggtaatccggcgcagatcccggaaatgcaggactacttccagacgctactgaccgacatgctggaaagtggcaaagcgactgatgcactgtgtaactacgacggtccacaggggaaaacggagctactcacactgcttgccggaatgctgcgcgagaagttgggttgggatatcgaaccacagaatattgcactaacaaacggcagccagagcgcgtttttctacttatttaacctgtttgccggacgccgtgccgatggtcgggtcaaaaaagtgctgttcccgcttgcaccggaatacattggctatgctgacgccggactggaagaagatctgtttgtctctgcgcgtccgaatattgaactgctgccggaaggccagtttaaataccacgtcgattttgagcatctgcatattggcgaagaaaccgggatgatttgcgtctcccggccgacgaatccaacaggcaatgtgattactgacgaagagttgctgaagcttgacgcgctggcgaatcaacacggcattccgctggtgattgataacgcttatggcgtcccgttcccgggtatcatcttcagtgaagcgcgcccgctatggaatccgaatatcgtgctgtgcatgagtctttccaagctgggtctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgccatcattcgccgctatttaccggaaaatcgctgcctgattcataaaccggaaggagccattttcctctggctatggtttaaggatttgcccattacgaccaagcagctctatcagcgcctgaaagcacgcggcgtgctgatggtgccggggcacaacttcttcccagggctggataaaccgtggccgcatacgcatcaatgtatgcgcatgaactacgtaccagagccggagaaaattgaggcgggggtgaagattctggcggaagagatagaaagagcctgggctgaaagtcactaaaaattgcctgatgcgctacgcttatcaggcctacatgatttctgcaatatattgaatttggaagaatttgtaggccggataaggcgtttacgccgcatctggcataaacaaagcgcactgttccggcgttgagaaacgccggaaaacgtttcaaacaggctgctgccgtagccgatgccgctgcactttctcgacatccatgcactgcaacgcctttgtcgggcaggcttcaacacaggccggtcccgtctcccgatgccagcacagatcgcacttaatcgccctcgcctttttgcgcgaagaaacgacctccatcgcaccaaacgggcaagccagcatacagcttttacagccaatgcaacgtgtttgttcaacgaaaatatgcccatgttcgcggcttatcgcgtcaacagggcagacattcgcgcacggtgcatcttcacactgatgacaggctactgccgtggtccagcagtggtctttaatgacacgaatacgggaaataaactcgtctggtgacaacgcagcgcaatcctgattctcatgatgcgacactgcgcaagccacttcacaggtacggcaaccgatacatttcgtcgcatccgcaataataaaccggttcatgatcactcctttgcactaaaacagcagagtgccagagagcgcgtccctactgctttgatccaacgaaggaaatgttaaagttttggcacttgtccaaagcgttatgtgatcgcgcccaggtcatccctgacagtaaatcccagttcattagaaatagcctgcgcggtttcacgcagtggtttcaggagatttttctctcccacctgtttcagacgtgatgtcgaaagcgaaatcgacacggcgtacggcacccgcccatgaatatcaaacaccggaacagcaatacaggagacgccgagttcgttttcttctctgtccatcgccgctccgctttcacgaatgtgcgccagttcgtcgaacatcgcgggcagctcggtaatggtattgcgggttaacggctggatctcatgctgatggctttcccagtatgacttcacgtagtccgggtgaccaaacgccatgtagatcttgcccattgcggaacagtagagcggcatatgctggccaatataggcacgggttcgcagcatcccggttgtgggttccagcttataaatcaaaatagcgtgatcgtcttcgcggctggagaagttaatggtttcaccagtggcgatgttcagtgcctcaagatgcggagcggcgatatgaatgatattcagcgaagacagcgccttctgcccgacggcaataaatttggtggtcaggcgataactccctgcggcaggcgcggtggtcacatagccgcaggactgtaatccctgcaataagcgatggacggtactcttatttaaaccagccagctccgaaagatgcgccaacggacaaccgtttggatagttgctcaaaatctcaatcagcatcaacccgcgaaacagactctggcttccggctggacgctctttttcctgcgccatctcgttctctttttttcccatcacttctttccccattttgtcgcgtcctgatggtagcgcaaagtgtgccgtagttcacgatctcgacagataatttataaccaattgatttttatgtcttttgaaattcatcaatcagattgccttgttaaaaagtgatcgatatatttgaaatcaagtttcgcatattgaaattttaagccaaaaaagcgatcaaaaaaacaaggaagcctgggatgaaagtgacatttgagcagttaaaagcagcctttaatcgggtcttaatttcacgcggcgttgacagcgaaacggctgacgcctgtgcagagatgttcgcccgcaccaccgaatccggcgtttattctcacggcgttaatcgtttccctcgtttcattcaacaactggaaaacggcgatatcattcctgatgcccaacccaaacgtataaccagcctcggcgcaattgaacagtgggacgcccagcgttcgatcggtaacctgacagcgaaaaagatgatggatcgcgccattgaactggctgccgatcacggtattggtctggtggcactacgtaatgccaaccactggatgcgcggcggcagctacggctggcaggcggcggaaaaaggctatattggcatttgctggaccaactccatcgccgtaatgccgccgtggggcgcaaaagagtgtcgcataggcactaacccgctgatcgtcgccattccttccacgccgatcaccatggtcgatatgtcgatgtcgatgttctcttacggcatgttagaagttaaccgtctggcaggtcgtcagctcccggtcgatggtggctttgatgatgagggcaatttgaccaaagaacctggcgttatcgagaagaatcgccgcattttgccgatgggctactggaaaggttctggcatgtcgattgtgctggatatgatcgctactctcctttccgacggcgcatccgttgccgaagtcacccaggacaacagcgacgaatacggcatttcacaaatttttattgccattgaagtggacaagcttatcgacggtcccacccgcgatgccaagctgcaacgcatcatggattacgttactagtgccgagcgtgctgacgaaaatcaggccattcgcttacccggccatgaatttactaccctgctggccgaaaaccgccgtaacggcatcactgttgatgacagcgtgtgggccaaaatccaggcgttatgaggagataagtcatgatttttggacatatcgcgcagcccaatccgtgccgtttgcccgccgccattgaaaaggcgctcgattttctgcgcgctaccgatttcaacgccctggagccgggcgttgtcgaaatcgacggcaaaaatatttatacgcaaattatcgatttaaccacacgcgaagcggtggtaaaccgtccggaagtgcatcgtcggtatatcgatattcagtttctggcgtggggcgaagagaaaatcggcattgctattgatacgggaaataataaagtcagcgaatcactattagagcagcgcaatattattttttatcacgacagtgaacatgaatcatttatagaaatgataccgggcagctacgcaattttctttccgcaggatgttcaccgaccaggttgtattatgcaaacagcctctgagatacgaaaaattgtggttaaagtcgcattaacggcgctgaattaatcgaataatcgtctacgccagaacgcctgggtaatgttattgctctaactatattaataattcaggttgctgcacatgcgacttgaattatgacagacatagcctcaaggaatagctatgaaaaaaatactcgaagcaatactggcgattaatctcgccgtactttcctgtattgtatttataaacattattttaagatatggttttcagacaagcattttatctgttgatgaattgtcacgttatttatttgtctggttaacgtttattggcgcgattgtagcttttatggataacgcccacgttcaggtcacctttctggtggagaaactctcccccgcatggcagcgacgagtcgctctggttacccattccttaatcttatttatttgtggcgcactggcctggggcgcaacgctaaaaacaattcaggactggagcgattattcaccgatcctcggtttacccatcggcctgatgtatgccgcttgtctgcccaccagcctcgttatcgcattctttgaactgcgtcatttatatcaactcatcacgcgtagcaattctctaacgtcgccaccgcaaggagcttaatcatggctgtgctgatttttctgggctgtctgttgggtggtattgctatcggtttgcctattgcctgggcactgttgttgtgcggggcggcgttaatgttctggctggacatgtttgatgtccagatcatggcacaaacgctggtgaacggagccgatagcttctccctgctggcgattccgttctttgtgctggcgggtgaaatcatgaatgcgggcggcttgtcaaaacgcattgttgacctgccgatgaaactggtggggcataaaccaggcgggctgggctacgtcggcgtgctggcagctatgattatggcgagcctttctggttctgccgttgcggataccgccgccgttgccgctctactggtgccgatgatgcgcagcgccaactatccggtcaaccgggcggcggggctgattgcctctggcggcattatcgcgccaattattcccccttccattccgtttattatcttcggcgtttccagcggattatccatcagtaagctgtttatggcgggcattgcccctggcatgatgatgggcgcaacgctgatgcttacctggtggtggcaggccagtcgccttaatttaccccgccagcaaaaagcaacgatgcaggaaatctggcactcttttgtctccggtatctgggcgctgtttcttccagtcatcattattggcgggtttcgctccggcctgtttacccctaccgaagccggggccgttgctgctttctatgcgctgtttgtcgccacagttatttaccgtgaaatgaccttcgccacactttggcatgtactcattggcgcggcgaaaaccacctcagtggttatgtttctggtggcctcggcacaagtttccgcctggctgattaccattgctgaactgccgatgatggtttctgatttactgcaaccgttggtcgattcaccgcgtctgctgtttatcgtcattatggtggctatcctgattgtcggcatggtcatggatttaacgccgacggtattaattcttaccccggtattaatgcctttagttaaagaggcaggaatcgatccgatttatttcggtgtcatgtttatcattaactgctcaatcggcttaattacaccgcctatcggtaatgtacttaacgttatttcaggggtggcaaaactcaaattcgatgatgcagtcagaggcgttttcccttacgtcctggttttatattcattattagtcgtatttgtttttattcccgatctcatcatcctccctttgaaatggattaattaaaaggaaaatattatgaaattacgctctgtaacctacgcattattcattgctggcctggctgcattcagcacatcttctctggcggcacaatctttacgtttcggttatgaaacatcacaaaccgactcgcaacatattgcggcgaaaaaattcaatgatttattgcaggagagaaccaaaggcgagctgaaattaaaactgttcccggacagcactctcggtaacgcgcaggcgatgatcagcggcgtacgtggcggcaccatcgatatggaaatgtccggctcgaataactttgccgggttatcaccagtgatgaacttgcttgatgtccctttcctgttccgcgataccgctcacgcgcataaaacgctcgacggcaaagtcggtgatgatctgaaagcctcacttgaaggtaaaggactgaaagtactggcctactgggaaaacggctggcgcgatgtcaccaactcgcgcgcaccggttaaaacccccgccgacctgaaagggctgaaaatccgcaccaacaatagcccgatgaatatcgccgcattcaaagtctttggcgctaacccgatcccgatgccgtttgccgaagtctataccgggctggaaacccgcactatcgacgctcaggaacacccgatcaacgtcgtctggtcagcaaaatttttcgaagtgcagaagttcctttctctgacgcaccacgcctattccccgcttctggtggtgatcaacaaagcgaagtttgatggcttaagtccggagttccagcaggcgctagtttcatctgcacaagaagcgggtaactatcagcgcaaactggttgctgaagatcagcaaaaaatcatcgacggcatgaaagaagcgggcgtggaagtcatcaccgatctcgaccgcaaagcctttagcgacgcactggggaatcaggttcgcgacatgtttgttaaagatgtgccgcagggagctgatctgctgaaagccgtggatgaggtgcaataaaccatgacgcaatactggctggggttagattgtggcggtagctggctgaaagccgggctgtatgaccgcgaaggccgggaggcaggcgtgcagcgcctgccgctgtgcgcattaagcccgcagccaggctgggcagagcgcgatatggcagaactgtggcaatgctgcatggctgtcattcgcgccctgcttactcattctggtgttagcggggaacaaattgtcggtatcggcatctccgcacagggaaagggcttgtttttgctggataaaaacgacaaaccgctcgggaatgctattttgtcctcggaccgccgggcgatggaaatcgttcgtcgctggcaggaagatggcatcccggaaaaactctacccgctgacccgacaaaccttgtggaccgggcatccggtgtcgctgttacgctggctgaaagagcacgaaccagaacgctacgcgcaaattggctgcgtgatgatgacgcacgactacctgcgctggtgtttaactggcgtcaaaggctgtgaagagagcaatatttccgagtccaacctctacaacatgagtcttggggaatatgacccgtgcctcaccgactggctggggatcgctgaaatcaatcacgccctgccgcctgttgtcggatctgccgaaatctgcggggagatcaccgctcagacagccgccctgaccggtctgaaagcgggtacgcccgttgttggcggcctgtttgatgtggtttccaccgcactctgcgccgggatcgaagacgaatttaccctcaatgcggtgatggggacctgggcggtgaccagcggcataacccgcggtttacgtgacggtgaagcgcatccgtatgtctatggtcgctacgttaacgatggtgaatttatcgttcacgaagccagccctacctcttccggcaacctcgaatggtttaccgcacagtggggagaaatctcgtttgatgagatcaatcaggccgttgccagcttgccgaaggctgggggcgatctctttttcctgccgttcctgtacggcagcaacgccggactcgagatgaccagtggtttctacgggatgcaggccattcacacccgcgcgcacctgttgcaggccatctatgaaggggtggtgttcagccatatgacccacctcaaccgaatgcgcgaacgttttactgatgttcacaccctacgcgtcactggcggcccggcgcactccgatgtctggatgcaaatgctggcggacgtcagcggtctgcgtatcgagctgccgcaggtggaagaaaccggctgctttggtgcggcccttgccgcccgcgtcggcaccggggtttatcacaacttcagcgaagcccaacgtgacttgcgacacccggtgcgcaccctgctgccagatatgaccgcccatcagctttaccaaaaaaaatatcaacgttatcagcatctcattgccgcacttcagggctttcacgcccgcattaaggagcacacattatgagccgaccacttctgcaactggccctcgaccactcatcacttgaagccgcgcagcgcgacgtgacgctgttaaaagacagcgtcgatatcgtcgaagcgggcaccattctctgtttaaacgaagggcttggcgcggtgaaagccttgcgcgaacagtgcccggacaaaatcatcgttgctgactggaaggtcgccgacgctggtgaaacgctcgcgcaacaggcgtttggcgcaggcgctaactggatgaccatcatctgcgccgcgccgctcgcgacggtagaaaaaggccacgcaatggcacaacgctgcgggggtgaaattcagatagagctgttcggtaactggacgctggacgacgcccgcgactggcatcgtattggcgtgcggcaggccatttatcatcgcggtcgtgatgcacaggccagcgggcaacagtggggcgaagccgatctggcacgcatgaaggcgctttcagatatcggccttgagctttccattactggcgggattacccctgctgacctgccgctgtttaaagatatccgcgtgaaagcgtttattgccgggcgggcactggcaggcgcggcaaatccggcgcaagtggctggcgatttccatgcgcaaatcgacgctatctggggaggtgcgcgtgcgtaatcatcagttagggatttatgaaaaagcgctggcgaaagatctctcctggccggagcggctggtgctggcaaaaagctgcggttttgattttgtcgaaatgtcggtggatgaaaccgacgaacggctctcacgtcttgactggagcgccgcacaaaggacttcgctggttgccgcgatgatcgaaacaggtgttgggatcccgtcgatgtgcctgtccgcacatcgtcgctttccctttggtagccgtgacgaggcagtgcgcgaacgggcgcgggaaatcatgagtaaagcgattcgcctggcgcgcgatctcggcattcgcaccatccagctggcaggttatgacgtctattacgaagaccacgacgaaggcacccggcaacgttttgctgaagggctggcgtgggcagtcgaacaggcggcggcatcacaagtaatgctggcggtggagattatggataccgcgtttatgaactccatcagcaaatggaaaaaatgggacgagatgctcgcctcaccgtggttcaccgtctacccggacgtcggcaacctcagcgcctggggcaatgatgttcccgccgaactgaaactgggcattgaccgtatcgccgcgatccacctgaaagacacccagccagtcaccgggcaaagtcccggacagttccgcgacgtgccgtttggcgaaggctgcgtcgatttcgttggcatcttcaaaacgctgcataaactgaactatcgcggttctttcctgattgagatgtggaccgaaaaagccaaagagccggtgctggagattattcaggcgcggcgttggattgaagcgcgtatgcaggaggctggatttatatgttagagcaactgaaagccgacgtgctggcggcgaatctggcgcttcccgctcaccatctggtgacgttcacctggggcaatgtcagcgcggtagacgaaacgcggcaatggatggtaatcaaaccttccggcgtcgagtacgacgtgatgaccgccgacgatatggtggtggttgagatagccagcggtaaggtggtggaaggcagcaaaaaaccctcttccgatacaccaacgcatctggcgctctaccgtcgctatgccgaaattggcggtattgtgcatacccactcgcgccacgccaccatctggtcacaggccgggctggatctccccgcctggggcaccacccacgccgattatttttacggtgccatcccctgcacgcgacagatgaccgcagaggagattaacggcgaatatgaatatcagaccggcgaagtgatcattgaaaccttcgaagaacgtggcaggagtccggcacaaatcccggcggtgctggtgcattctcacggcccgttcgcatggggtaaaaacgccgccgatgccgtgcataacgccgtagtactcgaagaatgcgcctatatgggtctattctcgcgccagcttgcgccgcagctccctgcgatgcaaaacgaactgctggataagcactacctgcgtaagcatggggccaatgcctattacgggcagtaatccctcacgccggggcttcatcgccccggcactacgaattgatatgttccttgctgtaacgccgcttccacgctgctggcgttaaaccagtatgtttctgaaaaatctgccggaaatagccaacgtcattaaaccgtattgcatggagcaggccgacaacgtcgagtcactgcataacctgttgctgcccgccgatgcgccatttacgacatttgaaggcaagggattgttcagccataagatcctgattcagacgccaggttcccggtatgaacagagcaatccagagcaacaacctttgtggcattacgacggagcaccagccgcaccgacatccaccggtgaattaaaaacgccagctcaccccggtgacaaaggtaaaactctcattacgatcaatcatcgggctgtcggtaatctcttccggcagctcgctgtatcctgcgctcgccatcaatacgacgtgctctcctatcgggtattttgccgtcaggctgacatagggcacccaggcatcctgcgcggaataacttgccagaccgctacgacgggactcactctctgaaatgccatagtaatagtcactgaaattctcgtcataatagagaacgcccagcgcaggtgtcagcgacagacgacctatctgcattttgtggaataccgatagctcccccacccagccgttgctgttatccagaacgtccgcagctgcagaggctttcacggttccccaacgctcgtggtgataccaggcaacccccgccatagccgtactatcacgcttatcaagctgttgcatggcataatcgtcattatcggtagggtcaaattccagcggcatccaggatgcggtcaggctaagttcatttttttcactttgcgacagaataaaacctaacgtggtctgacgaacataaaaagtatcaccttcataactaatcagcggaattgccttcgtattttcattataaccgcgataaggcgattcattataagccgcaccagcaccaatggataattcagaagcagttgcgcttgccataaaaggcaacgcaaataacgccacaatattgcgattaattaacatgtccggtattccattttaaaataagataaaaaagagtcggcataataatgcttacaatttctccggtgcaagattcatatttatatagtaatatataaaattatatataattgggctgttgcgatgacaaaattacaacttaagtaccgggagttaaaaattatctcggtaatcgctgccagtgaaaatatcagccatgccgcgactgtacttggcatcgcacaggccaacgtcagcaaatatcttgctgattttgaatcaaaagtgggtttaaaagtctttgaccgaaccacccggcagctgatgctcacaccttttggcaccgcgctgttaccgtacatcaacgacatgctggacagaaacgagcaacttaataattttattgcagattataagcatgagaaacgtggtcgggtcaccatctacgccccaaccggcataattacctatttatccaaacatgtaatcgataaaattaaagatatcggtgatatcaccttatcgctaaaaacctgcaatcttgagcgtaatgccttttatgaaggcgtcgaatttcctgatgattgtgatgttttaatcagctacgctccaccaaaagatgaatcgctggttgccagttttattacccaatatgccgtaaccgcttatgccagccagcgctatcttgagaaacatcccattagccgtcctgacgaactcgaacatcactcctgtattttgatcgactcgatgatgatcgacgacgcgaatatctggcgcttcaacgtcgccgggagtaaagaggtgcgggattatcgcgtgaagggaaattacgtttgcgacaacacgcaatctgcgctggagctggcacgaaatcacctggggattgtgtttgcgccagacaaaagtgtgcagagcgacctgcaagacggcacgctggtgccctgctttcagcaaccctatgaatggtggctggatctggtggctatcttccgtaaacgggaataccagccctggcgggtccagtatgtgctggatgaaatgctgcgtgaaattcgccaccagcttgctcagtcgcagcaactgcggcctgaacaagcggcggaaagcgaagattaatgatcgagataaaggtaatgcacccagctggtcatgcgtaatagcactttgcgcatcaccgagacatggctgaaatgatcagagtaaaccgccacctgggcgtaaataccgtctggtaaagcgctcaaatcagtgtgctcatccagttcaatggtcgcgataacgccatctgaacccggcgctgtgtttaacgtctgtaaggtgccggtcgactgataagctccgccgggaacggctggactaatggctgccagcttaccgctgaataccttacctggcagagcattaaacaccacttccgcatcgtcgccaggagccagtcgcagcaaggagttctgacggaactgcgccacgatttgtcgtttctgatcgggtataaacaccatcaccggacgtagcggcagcgacgcggcataggtacccggacgaatcagtacctgggtcacataaccatcgctcggcgcacgcactatcgtctgctcaaggttatattttgcttccgcgagctgtgctttcaggctggcgatttgagaatgttcacccaacaccaggctatccagctggctctggatctgtttttgttccgccgccgatgacttcacggaggcttcctgcgccagataattttgccgcgccacatcgatatcgcgttctgaaaacgggtttactttcgcctggctgccacgtgcgtaacgctgatactctttagcgaatttatcccgcgtggcctttgcctgctgagtattcgccgccatctcatctaactctgcgcccaacgcccgctgtttatgttctgcggtaacgatatccgccatcagccgatccacccgcgcctgataacgcgtcgggtccagtcgaaatagcacctcaccttttttaatcagcgtatttttcttatccgtcacttcaatcaccacaccagtcacctgtgggacaacaggaatagaaataaccgctttttgcgctttaaaggtatacggatggttatagttcattaacagaattagaccgctgacaataaatattccacccagggccgctgtgggaatggtccatttatttacgggaattttgaagatcttaaacattgcccatgcaaaagccacataggtcaaaataatcagtaaatccataagtattactcggcagaagaggatttgatgtcggcgagctgtttctccagcccggcaatgcgctgttgcagttgcataacggatgaatcatggctttgcattccccatccccgctccgggcggtaaagcgtggcccaaatccacaaaaacggccagataacatgtaacgtaaaaagactcacccaaccagcaacatgaatggcgtcggcatgaggatgattacgttttttggcaatcaggtagggaatatcatgtaaaataatgatcccatagaagatcaccagaaatacaaaaataagcactcccagtgcaaaatagtccaggaacatatttccctcaaagaatataaaaaagaacaattaacgcatattatgaaatgccatgatgcagtgcaatttccttatttatataacgacatattgttttttatatactttcttaaatgtgctgtctggtttttcaacaggacgaggtttatcatattgaaatagtggaactattggccaaactaatgaataactccagtaaaacatccacagtacagattaagcgtattaaaccttcaattatctaccgtttattgctgattggcctcggatcaccaatggtgatttacggcctggttcgcccgctcaccatcgaaacgcgagattaaactcctgacaaaacacgccccagaaacgtacttctgttggcgtagtctgggttattgcgcacgtaggtttaaaacgtaaattgtaacaacgtgcgctttgtttatgccggatgcggcgtgtacgccttatccggcctacggtcaggttcccgtaggcatgataagacgcgtaagcgtcgcatcaggcaatgaatacccaatgcgaccagcttcttatatcagaacagccccaacggtttatccgagtagctcaccagcaggcacttggtttgctggtaatgctccagcatcatcttgtgggtttcgcgaccgatacctgattgtttgtagccaccaaacgccgcatgtgccgggtaagcgtgataacagttggtccacacgcgcccagcctgtatgccgcgccccatcttataggccagattaccgttgcggctccagacgcccgcgcccaggccatattgcgtatcgttcgccagctccagcgcttcttccatcgttttgaaggtggtcaccgccagcaccgggccaaaaatctcctcctggaacacccgcatattgttctgaccaaacagaatcgtcggttcgaggtagtagccgtctttcagttcaccttccagcagcttgcgccgcccgcctgtgagcacgtcagcgccctcttttttaccgatatcaatgtagttgaggatggtttccagttgcccgtgagaaacctgcgcgcccatttgcgtcacgctgtcgagcgggttaccgctacgaatgctttcgacacggcggatggcgcgttccataaagcgttcgtagatagattcctgcactaaagcacgactcggacaggtgcaaacttcgccctggttaaaggcaaacagtgcaaagccttccagcgctttatcgaaaaaggcatcttcttcatccatcacatcagcaaagaagatatttggcgacttaccgcccaactccagcgtcaccggaataatgttttgcgttgcgtattgcataatttgttggcccacttccgttgagccggtaaacgccactttggcgatgcgtttcgaggtcgccagatattcgccaattaccccacctgcgccattgaccacgttcaccacgcccggcggcagtaaatcaccgacaatttccattagcagcagtacagaaagcggggtaagacgtgcgggtttcagcaccacacagttgcccgccgccagcgcgggagccattttccagctcgccatcagcagcgggaagttccacgggataatctgccccaccacgcctaacggttcatggaaatgataggccacggtttcgctatcaacttcactgatcccaccttcctgcgcccgaatacacgaggcgaaatagcggaaatggtcaatcgccagcggtacatccgcagcactggtttcgcgaatgggtttgccgttatcccaggtttcagctgtcgctaacagctcgaggttttgttccattcgatcggcaatcttaaacagaatcgccgcacgatcctgcaccgaggtgtgcgcccatttatctttcactttgtgcgcagcatccagcgccagatcgatgtctcgtttgcccgaagacgccacttcgcacagcagctgcccggtcaccggcgtcagattctggtaatactcgccgtcggcaggggctacccattcgccgccaataaagttgtcatagcgggcttttaacttgagggggaaaccatactcgccgggcttaatctgtgctgaagggggattattggtcatgatcgtctccttgcggtgtgaggtataacaagggtagacgtgactggcgaaatcttcgccagtcggtaacagctttacgacagctatcacgaatttacgggcaagggttacagagatagttgaaaaagcggctaacaatttgccagccgttgtggaaatgatgattacatcgctgcgcgataaatcgccacaatttcttcgtgagttgcctggatcgggttagtaaagccacaggcatctttcagggcattagtcgccaataccgcgaaatcttcttctttcacgttcaggtcgcgtaggcctgccgggatatccactttcttcgccagttcacggatggcgttaatgcaggcttcagcaccttccgcgtcgtttttacctgtcacgttcacgcccattgcagcggcacagtcacgcagacgtgcagcggcgactttgctgttgaatacctgaacgtgcggcagcaaaacggcgttacatacaccgtgtggcaggttgtagaaaccgcccagctggtgcgccatcgcatgaacataacccagagaagcattattgaacgccataccggcgaggaactgggcataagccattgcttcacgcgctttcgcattactgccatcttcaacggctaacggcaggttttcggcaatcatggtcacggctttcagtgcacaagcgtcagtgatcggcgtggcggcaatagaaacatatgcttcgatagcgtgcgttaaggcatccatacccgttgcggcggtcagtgacttcggcataccaatcatcagagaggagtcattgacagaaagcagcggagtgacatgtttatcaacaatcgccattttgatatgacgcgcttcgtcagtgatgatgcagaaacgggtcatttcagaggccgtacccgccgtggtattgatggcgatcatcggcagctgcggttttgcagagcggtcaacgccttcgtaatcgcgaatatcgccgccattggctgccaccagcgcaataccttttgcgcagtcgtgtggagaaccaccgcctaaggagatcacgctatcgcaattattctctttaagtaatttcaaacctgcggcgacgttttccgtggtggggttaggttgggtgccatcataaataacgctaaaaatattgcgttcttccagtgctttttgcacatcgcccgccatacctaatttcgttaacatattgtcagtgacaattaaggtacgggtaaatccataatctgccatcatattcattgcatcagtcaatgaatcagcgccgatgacattcacagaaggaataaagaacgttgaagctgccataacacactcctgaaagtgtaaaaaagggcgggcagcttactgaggattttcattcgaaaatatgatcagtattattgattatcaaaattaatctaataaaaagcacattgtattcattaaacaatgtgctttttttaaattcataagaattttgtattaatttattttaaaacttaattaatcatttccttatttttccggaaataataatgcgtcgcgcaataaatgatcatttccacgacgacgcgtaaagccaatgcggtcaaaatattccagaatctgaattgccagctttcggcctacgcctaagcgatcgcggaaatccgccgcgcaggttgaaccacactcctgatcgagatcgcggatcatattggcaaactcgacaatccgatcgttacggtaataacgatctttaacgatcgcggtaattattccttgctgcgccgcctggcgtagagtcaggcgcattgcctgctcgtcggttcccgtctcttttgccaggtcacgcacccaccacggttcgtcaccaaacagtggctctgctttttgccagatggcctgctgctcttcgctgaagcccgctttgtgatctggcagatgcagccagccgtgatggctgtggatgtcgccgctttcgcgcatcttttcaatcagcaacagtaccagcgcttcatcttccattggcaacgccatacgtcgcagacgttcgcgcccagggccaggttcatcgcgatgttgctcatgataagtcgctaatgtgtcgagaattttccgctgccagcgggcggcaaccggcgcattcaacaagctataaccagcctgaatataaccaggctgttgcagcaattcgcgcatcccttcgccgttgagctggcgcgcccaggcgaaatccgcaaggttaaccgcgccgcgttccagatgaacagataacgcatcggcatcgctctgcgcccgtgcaagagacgccagccattgcagatattccggcttacgtttaccgcgacgcggcgggttaagcatcacgacgcgcgctccggccagcgtgttgcgggcagagatatcgcgcaataccaggcggtcgttatctgccagccataacggggtgtcgaagaccagttcagcaaggttatcttccagcagtgaaacgcgtcccgtgacgtggctggcggcgtggtgaatatgcagcggctgccactgggtcagcggtgtatgggtttgaagctcgacaatcacccgtgtgaacggctctggcggcacatcggcaagcagccagtcgccacggttaatctgctctttttccgcatcacccgcgatgttaagcgcgatacgctgcccggcattggcggtttctgttggctggttttgcgcatgcagcgcacgtacacgcatcggtttatttacaccagtcagccagagtgaatcgcctaccttcacttccccgcttaacgccgtaccggtgacgaccagcccggcaccttttacggtaaatgcgcggtcaatcgcgaggcggaaactatgttggctggcgtgctcgcgttccggcaactgaagcagatgctcgcgcagggcatccattccccgaccttcggttgctgcggtgataaacagttttgcctcagcaaaaccgtattcccgcagaacctcctttacctggcgttcaacctcatcaacacgcgcttcgtccacgcgatcggctttggtcagcgccactgtcagcatcgggttaccggtcagctgcaaaatcgccagatgctcacgggtctgtgccatcacgccgtcatcgcacgccaccaccaacagcgcgtgatcgataccaccaacgcccgccagcatgttggaaagaaacttttcatgaccgggaacgtcgataaaaccaggcacgcgaccatccggctgcggccagtaggcatagccgagatcgatggtcatgccgcgctttttttcttccggcagacggtcagcatttacgccagtaatcgcctgcaataaggttgttttgccgtggtcaacgtgtccggcagtcgcaataatcatttcaacaacatctccaaaaaccgttgctcatcttcaaggcagcgtaaatccagccacaatcgtccgtcataaatacgaccaatcaccggcactggcaattcacgccagcgggcggctaatgactcaaggtggctaccgcgtccatcatggggtgtaaacgttaatgccgcgctcggcaggcgatcaaccggcagcgaaccactgccaatctgcgaaagacatggcataacctgtaccgcaaactccgcgccgtaatgtgcggcaaggggggcctgtaaacgttgtgcctggatttgaatgacctctgcgctgcgggtaagcaggcgcagggtcggtaatttttcactcagagcttcagggtgtaaataaagacgcaacgtggcttccagcgccgcgagggtcattttatccgcgcgtaatgcacgcttcagcgggtggctttgcaggcgggcgatcatctcttttttaccaacaataattcctgcctgcggcccgcctaacaacttgtcgccggagaaactcaccagactgacgcccgccgcaatcaactcctgcggcattggctctttcggcaaaccgtactggctaagatcgaccagcgagccactgcctaaatcagtcactacgggaacatccagctctttgccgagcgccaccagttccgcttcatctatcgctttggtgaacccctgaatgctgtagttactggtatgtactttcatcaacagtgcggtattttcattcaccgcctgacgataatcattcgcgtgcgtgcggttggtggtccctacttcgtgtagggtgcagcctgcctgacgcataacatcgggaatacgaaacgcgccgccaatctccaccagttcgccgcgagataccaccacctcttttccgctggcagtggccgccaacatcaataacaccgccgccgcattgttattgacgatacaggcatcttccgcccccgtaatacggcacagcagctgcgccagcgcccgatcgcgatgtccgcgtccggcgtcgtccagatcatactcgagggtcactggcgaacgcatagcctgcgcaacggcttccaccgcggcttccgcctgtaaagctcgcccaaggttggtatgcagcacggttcccgtcaggttgatcaccggacgcagcgcgctctgcgcttctttcgtcaaccgggcatcgacttcttgcgcccagttttcacaccacgcaggcagcgtctggctgccacgaatcacttctcgcgcttcgtcgagcatctgacgcaacaattccaccacgcgggtgtgaccataagtatcacgcaaagaaaggaaggagctatcgcgcaataagcgatcaatagccggaagttgactatagagggaacgcgtttcggttgtcataggaaacctggctgatcaaggccctctcacacggagaagggcgtttaacataaccacggattgtaacgtgagatgggtcaggaggacatatcgcgcatcaagcctttggcggttcggtgcgagcaaaactttcgcggctaaacaggttttcgaccagtttgactaagtgtgggcggtcgacacaccaacctggcgcaacgcggcggaaattgagatatccgacggcacaggcaatggcgatagtcgccagattgaccgtatcggttttgagtgtgccatcgaccagatatccttccagcacatccagactgcggttgattttctcccgctggcgtaacaattcatcttcagactgctgcgccgctggacgcgcctgttcacgcaccgataccagcccggcatccataatgccatccgccagtgcctcaattttgcgcacccgcaacgactccagcggatcgcgcggcaacatcgccggagcgacattcattaattcaatatattcagcgatgatcggcgaatcaaaccagcattcgccctcttcggtcaccagcaccggcacttttcctaacgggttaaattgcgccacgccgttgtccgcgttatagggcagttcattaataaattcgaaagttatgcccttttctaacaacagaatagaaagtttgcgtacaaacgggctggtgtagctaccgacgagtttcatgccgagtcctttgtgcgaggaaaaatatcagtatggcctggtgatgggaaaaagggcagaaaatgttgatggtttgttacttccaaataaatcacatatttatcatggtgatataaatattttcctaattatttcactctgatggatatctcacttcaggctttcttataaatctgtagggtttcgcctgtcagcagacaaataacccgataaaacaaggatgagaaatgagcggaaaaccggcagcgcgtcagggcgacatgacgcagtatggcggtagcattgttcagggttcagccggggtgcgcattggtgcccccaccggcgtggcctgttcggtgtgccccggcggagtgacgtccggccatccggtcaatcccctgctcggtgcaaaggtccttcccggtgaaaccgacatcgccctgcccggcccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggttggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgcctggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccacgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcagggcacagacggatgccgcaggcaggacaacagagtacagcccggatgtggtgacgggcctcatcacgcgcataaccacgccggatggcagggcatcggcgttttactataaccaccacaaccagttaacgtcagccaccgggcctgacgggctggaattgcgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctaacgcgcagtatggaatacgatgctgccggacgggtcatccgcctgaccagtgaaaacggcagccacaccaccttccgttacgatgtacttgaccggctgatacaggaaaccggctttgacggccgcacacagcgttatcaccacgacctgaccggcaaacttatccgcagcgaggatgagggtctggtcacccactggcactatgacgaagcagaccgcctcacgcaccgcaccgtgaagggtgaaaccgcagagcggtggcagtatgacgaacgtggctggctgacagacatcagccatatcagcgaagggcaccgggtggcggtgcattacaggtatgatgagaaaggccggctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggttacctggcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattacgacagtcagcaccggctggtgcactacacgcggacacaatatgaagagccgctggtcgaaagtcgctatctttacgacccgctgggccgcagggtggcaaaacgggtgtggcggcgtgaacgggacctgacgggctggatgtcgctgtcacggaaaccgcaagtgacctggtacggctgggacggcgaccggctgaccacaatacagaacgacagaacccgcatccagacgatttatcagccggggagcttcacgccactcatcagagttgaaaccgccaccggtgagctggcgaaaacgcagcgccgcagcctggcggatgcgcttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcccttatcagcaaggaagggacaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggcggtatatcactcaggatccgattgggctgaaggggggatggaatttttatcagtatccgttgaatccagttacgaatacagatcctctggggttagaagtttttcctagaccattccccttgccaattccatggcccaaaagccctgcacagcagcaagcagatgataatgctgcaaaagcattgacaaaatggtggaacgatacagcatcacaaagaatatttgactctctaatattgaataatccgggactagcattagatataacaatgatagcttctcgtggaaatgttgcagacacagggataactgatcgtgtcaatgacataataaatgacagattctggagtgatgggaaaaaacccgacagatgtgacgtacttcaggaactaattgattgtggtgatattagtgctaaagatgcaaaaagcacacagaaagcctggaattgtcgtcactccagacagtcaaacgataaaaaaagatagcccttgtggaggttcctgcaatgtcaaatacataccagaaaagaaaggcaagtaaagagtatggtttatataatcaatgtaagaaactaaatgatgatgaattatttcgcttacttgatgatcacaattccttgaaaaggatttcatctgccagagtattacagttaagaggtgggcaagacgctgttagattggcaattgagttctgctctgataaaaattatatccgtagagatatcggagcatttatactcgggcaaataaaaatttgcaaaaaatgcgaagataatgtttttaatattttgaacaatatggcattgaatgataagagcgcttgcgttcgagctacggcaatcgagtcaacggctcagcgatgcaagaaaaacccaatttattcacctaaaatagtagaacaatctcaaattactgcttttgataaatcgactaatgtcagacgtgctacagcatttgctatttctgttatcaatgataaagcaacaattccactattgattaatctgttaaaagatccaaatggagatgtcagaaactgggccgcatttgcaataaatatcaataaatatgataatagtgatattagggattgttttgtggagatgcttcaggataaaaatgaggaagtccgtattgaagcaataatcggactttcctacagaaaagataaaagggttttatctgttttatgcgatgagttaaaaaaaaatactgtttatgatgatatcattgaagctgcgggtgaattaggtgataaaacgctacttcctgttttagatactatgttgtacaagtttgatgacaatgaaattataacttccgctattgataagctgaagcgttcatagcgtgagttgcctatgcacagtgggggattcccgccggcacggtgcagatgctcgaccggctggaaagtgaaatcctggctgaccgggtgagtgaggaaagccgccgctggctggcatcgtgcggcctgaccgtggagcagatgaaaaaccagatggacccggtgtacacgccggcgcgaaaaatccacctgtaccactgcgaccatcgcggcctgccgctggcgctcatcagcacggaaggggcaacagcgtggtgcgcagaatatgatgaatggggcaacctgctgagtgatgagaacccgcatcatctgcagcagctcattcgcctgccgggtcagcagtatgatgaggagtccggcctgtattacaaccgccaccgctattatgacccgctgctggggcggtatatcactcaggatccgattggactgaaggggggatggaatttttatcagtatccgttgaatccggtcataaatgtagatccgcaaggtttggttgatataaatttataccccgaaagtgatcttatccattctgtagctgatgagattaatatcccaggcgttttcacaatcggggggcatggtacccccacatctattgaatccgcaacgcgcagtatcatgacagctaaagatctagcatatctaattaaatttgatgggaattataaagatgggatgacagtttggttattttcttgtaatacaggtaaaggacaaaattcatttgctagctaattagctaaagagttacatacaaatgtaataggacctgacacgctatggacgtggtgggggcgaggaactaatggtaagttaaaaatggatacagtgctaacagcaccaacgaaccttaattcaaataaggatctaatggctataacaacaaaagaccttggtaattggataacatatgggccatctgggcaccccatttctaatatgcaaggtacgccagaaaaacccagtgatataagataggttgtagatgtatgaaagcatgcttgttactatttttttatttctcttttatttgtcaattgcatggtgctgatgtgaaaataaaacaaaacgaaagtatgatggggtctacagcaatgacctatgatttaagtgaagaaaagttgatgaaactgaagtataaatcacaacatggtgattcagaggcatcatttcgactatatcaatattactgctttactaaaaataacatttacaaacaattgcgattcttggaaagatcagcatctcaggggaatgttacagcgcagtttaattatggggtctttttatcagatacaaatccaacattatcagaatattataatttgaatagagctatttattggatggaattcgctgtaaataacggtaatattgatgcaaagagcaaacttcaagagctcaaaaagctaaagcgaatggatagaaggaagaataaggagaatccgtaaaagcaatagttcatcagactgccgcagcagtagtatgatgatgaatcagggctgtactataactattatcggtaacattaaccgcagcaggggcggtataacactcaggctccgattgggctggaaggtaggtggaatttttatcagtatccgttgaacccgatttctggaatcgatccccttgggattagccacctgtttatacagcataactttaggtatgctttcgtgtgtttcagatataccatgtgatgataatttttatgatgtgcttagtattccagtcgcttctggtaataatatgcaatgtaaaaataatccccgttgtacacatttataaatagatggccaatacctcaaggcctatggagttggaatgttaatgacccgggagcaagcaatagaaaacctgacggcatacgattagtaccgtcagttaatacaggaacttataatcgcaatggattttcaatacatagttgtttaaacgcttttggtccgtctttaggacctcgattctgttccgagggttgtataactggtttatctaatgacatgcaaaaattaaatgagttaatattttcagagccagatagcacattaacagttacggactaaaaaatatggcaaggttattaacaattgtatttttttctctatttctgcgagtgcagttactgcaagacaatttcagagagagttagatttggcagacaaagcaatattatgggcactaatatcagccagtactaaagagggacgaaaagcgtgttcactaagctattttgcctgtaaggccgcagaggctgaactcggactggcatatatggctgcgaatgataacaaggaatttctcacatccttatctaatataatgaggtacaaaatagatgctggactttccgaatcctatacatgctatttattaagtaagggaaagatcataagaccatatctgaaaaatctaaatccactccaacttgccgctgattgcattgaaacagtaaataaaataaaagataagaataaaaaaaatcattgatataaattcagttaatatttgtagtgatgataaaaatataaaattgagagttaatagtactattatggccattgatgattctataaagtgcatcgatgaatgataacttaattttatttaaaaatatattaataactcactctccaggagtttttttaacttagttttataatgaatacgataattaaaagtgaagaagaaaatagttgtatacatatattccatgaccctacattgtgatctatagattaaatattttttaaatgtgactgtcatccttcagataataaagccatcatcgcaatagatggaaaagcactcctgctcttttttgattagagccgtcgcaggaggaacaactcatatcatcattgcgatctcgacgatgtatagtctcatcctgcggcagaacaagacggataaaaaatccaatgagagcacactcatccagaacttattaacataatgaatattaaagaaaaatcatcgaagctaatgaagtaatatgcaaaaataattagtccttacaaggagcaaagttccataatctcccccctccccctcaatgatccaaataaagataatgcatccagctggtcattcttagcagcactttccgcatcaccgaaacatggctgaaatggtcggagtaaaccgccacctgggcgtagatgccgtcgggtaaggcatcgatatcatcgttagggtccagttcaatggttcccagcacaccgtccgtgccgggcacgaccgttaatgattgcaataccccctgcgcctgataagaaccgcctggcacgacaggtaaaatactagtcagtttgccgtgaaacacctgcccaggtagcgcgttaaacaccacttccgcatcatcgccaggtttcagacgtaacagcgagttttgccgaaattgggcgacaatttgccgtttttgctcggggatgaagaccatcaccggacgcagcggcaaggcagctgcgtatgtacctgggcggatcagtacctgagtaacgtagccattgctcggcgcgcgaatgacagtctgctcaaggttatattttgcttcagtaagttgcgctcttaagctcacaatctgcgattgctcgccgttaaccatactgtcgagctggctctggatctgcgcctgctccgccaccgagcctttcaccagcgcatcctgcgcgaggaaattttgccgcgcatcgtcgatgtcacgttccgagaacggattcaccgccgcctggctgcctttcaagtaacgttgataatttttaaacagacggtcgcgctccgctgaaacctgggtggtgttggcctgcgcttcagtgagctgcgcacgcagcgtctttatattatgcgtcgccgtcatcaggtcagcctgaagtctgtcaactcgcgcctggtaacgaaccgggtcgagcttaaaaagcacctcgcccttttgaataagctgattattcttgtcagtgacttcagtaacaattcccgtcacctgtggcgtgatagggatcgctatcactgccttttgcgcggtaaaagtgtaagggtggttgtagttcatcaacaaaatcaaaccactcaccagaaacacgcctcccagcgccgccgtcgccagcgtccactgatttaccggaatgcggaagattttaaagaccgcccacgccagcgccacgtaagttaaaacaatcaatagatccataattagatctccgggaacgtggaatagtcagtctttttctcggcggcgagttgatgctccagccgggaaattcggtcagaaagtgcggcgatttccgggtcagtcgctttctcctgcgacgcaacatgtgactgcataccccagccacgctccggttgatagagcgtcgcccagatccacagaaacggccagataacatgcagagtaaacaggctcacccagcccgccgtatgaatagcgtcggcatggggatggttgcgctttttggcaatcagataagggatgtcatgtatcgcgatgattccataaaaaatcaccagaaagacgaagatcagcactcccaacgcgaaatagtttagaaacatatctgcctcggattcacgtttatcagtgttgtttttgggctggcagccagaagggagtcaggctgatattttgacaataatccgggttcgcgattctcgccataacaccaaagaataatttttagaggtgatgagttgcttagttacataacgattgtatgacgaaggcataacatgctgtagatcacatcaggtgaacgccgtaagaaaatatcttgtgattcagatcacaaagattcaacaaaccatcaaaacaaaaatgtgacactactcacatttaaatgccatttttagcgaaaatcgccgccttgttgcttttttacacaagcgttttgtgatgaacgtcacgtcaattacctctctaccccctatatttatgtgattgatatcacacaaaaggccgtcgactggacagttaaccgattcagtgccagatttcgcagtatctacaaggtccggctacctctgccgccacattaacaaaaaacctcgggcttccagcctgcgcgacagcaaacataagaaggggtgtttttatgtcatccgatattaagatcaaagtgcaaagctttggtcgtttcctcagcaacatggtgatgccaaatatcggcgcgtttatcgcgtggggtatcatcaccgcgttatttattccaacagggtggttaccgaacgagacgctggcgaagctggtcgggccgatgatcacttatctcctgccgctgctgatcggttataccggtggtaagctggtaggcggcgaacgtggcggcgtagtcggtgccatcaccaccatgggcgttatcgtcggcgcagacatgccgatgttcctcggttctatgattgcaggtccgctgggcggctggtgcattaagcacttcgaccgctgggtagacggtaagatcaaatccggttttgagatgctggtgaataacttctccgcaggcatcatcgggatgatcctcgctattctggcattcctcggcattggcccgattgttgaagccctgtccaaaatgctggctgcgggcgttaacttcatggttgtccatgacatgctgccgctggcgtctatctttgttgaaccggcgaaaatcctgttcctcaacaacgccattaaccacggtatcttctcgccgctgggtattcagcagtcccatgaactgggtaaatcaatcttcttcctgattgaagctaacccaggtccaggtatgggcgtgctgctggcgtacatgttctttggtcgtggtagcgctaaacagtctgcgggcggtgcggcaatcatccacttcctggggggtatccacgaaatctacttcccgtatgtgctgatgaatccgcgtctgatcctcgcagtcatcctcggcggtatgactggcgtgttcacgctgactatcctgggcggtggtctggtttctccggcatctccgggttctatccttgctgtactggcgatgacaccaaaaggtgcttacttcgctaacatcgcgggtgtgtgtgcggcgatggctgtctccttcgttgtctctgctattttgctgaaaaccagcaaagtgaaagaagaagatgatattgaagcagcaactcgtcgtatgcaggacatgaaagctgagtctaaaggcgcatctccgctgtctgctggcgatgtgactaacgacctgagccacgtacgtaaaatcatcgttgcctgtgacgccggtatgggttccagtgcgatgggcgcaggcgttctgcgtaagaaaattcaggatgcaggtctgtcgcagatttctgttactaacagcgcgatcaacaacctgccgccagatgtggacctcgtcatcactcaccgtgacctgaccgaacgcgctatgcgccaggttccgcaggcacagcatatttcgctgaccaacttcctcgacagcggcctgtacaccagcctgaccgaacgtctggttgctgcccaacgccacacggcaaacgaagagaaagtaaaagacagcctgaaagacagctttgacgattccagtgctaacctgttcaagctaggcgcggagaacatcttcctcggtcgcaaagcggcaaccaaagaagaagcgattcgttttgctggcgagcagctggtgaaaggcggttacgttgagccggaatacgttcaggcgatgctggatcgtgaaaaactgaccccgacttatctgggtgagtctatcgcggtgccacacggtacggttgaagcgaaagatcgcgtactgaaaacgggcgtcgtgttctgccagtacccggaaggcgtgcgcttcggtgaagaagaagatgacattgcccgtctggtgattggtattgctgcccgtaacaacgagcacattcaggttatcaccagcctgaccaatgcactggatgatgagtccgtcatcgagcgtctggcacacaccaccagcgtggatgaagtgctggaactgctggcaggtcgtaagtaatccaatcccaccctctccacatggagaaggtggggttaattgcctgatgcgctacgcttatcaggcctacaggatgcatcacaatttgttgaatttgcacgttcttgtaggccggataaggcgcttacgccgcatccggcgctgcccctctcctcacggagagggtttgggtgagggaaaagcctcaccccagccctctcgggtaaaaacattgatgaaggttaatactatgaaagcattacattttggcgcaggtaatatcggtcgtggctttatcggtaaactgctggcagacgcgggtatccaactgacgtttgccgatgtcaatcaggtggtacttgatgccctgaatgcccgtcatagctatcaggtacatgtggttggtgaaaccgagcaggtagataccgtttccggcgtcaatgctgtcagcagcattggtgatgatgtcgttgatctgattgctcaggttgatttagtcactaccgccgttggcccggttgtgctggaacgtattgctccggcaatcgccaaagggcaggtgaaacgtaaagaacaaggtaatgaatccccgctgaacatcatcgcctgtgaaaacatggtacgcggtaccacgcagctgaaaggccatgtgatgaacgccctgccggaagacgccaaagcgtgggtagaagaacacgttggctttgtcgattccgccgttgaccgcatcgtaccgccttcggcttcggcaactaacgatccgctggaagtgacggtagaaaccttcagcgaatggattgtcgataaaacgcagttcaaaggcgcactgccgaacatcccaggcatggagttaaccgacaacctgatggcatttgtcgaacgtaaactcttcaccctgaacacgggtcatgctataaccgcgtacctcggaaaactggccggtcatcagaccattcgtgacgcgattctcgacgagaaaatccgcgcggtggtaaaaggtgcgatggaagaaagtggtgcagtattgatcaagcgctacggctttgacgctgacaagcatgcggcgtacatccagaaaattctcggccgttttgagaacccgtatctgaaagatgatgtagagcgcgtaggccgtcagccactgcgtaaactgagtgctggcgaccgtctgatcaagccactgctcggtacgctggaatatggtctgccacataaaaacctgattgaaggtattgccgctgcaatgcacttccgcagtgaagatgatccgcaggctcaggaactggcagcactgatcgctgacaaaggtccgcaggcggcgctggcacagatttccggtcttgatgccaacagcgaggttgtatccgaggcggtaaccgcttataaagcaatgcaataatggtggaccaggcgcaggacaccctgcgcccgaataacagattgtcagatatgcaggcaacaatggaacaaacccaggcctttgaaaaccgtgtgcttgagcgtctgaatgctggcaaaaccgtgcgaagctttctgatcaccgccgtcgagctcctgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacgagtacgcctttaccgacgacgaaatccttggaccctttggtgaactgcactgcgtggcggcgttaccaccgccgccacagtttgaaccagcagactccagtttgtatgcaatgcaaattcagcgctatcaacaggctgtgcgatcaacaatggtcctttcactgactgagctgatttccaaaatcagcttaaaaaaagcctttcaaaagtaagcaacgtctgcttactgcccctctacctgcttcggccgataaagccgacgataatactccagacgttgtagatataacggcacgctttcatcgggtattccggacggaatcgcgttacggggaggaagttttttcagatactcccggaacgcctggcttgatgccatgaaatctacggctttatcgataagaagcggaacgttttcacctaatttgcccatgatgatatctccgtattaccccgcgccgggaatgcgcggccgccaattttagtttaggttcccggtaaagatgacattaaggaaaacgtgctgaatcctcaataatcatccgctgctgtttattatcttttttctatagatttcttaattaatcaacgaattgcgcagtttttgagcatgttaatgattacgttacagaactattacaatgtcattagttgtgaacaaagcacctggtcgcgcatactaggggctataaatttatctttatcagaagccatcacatgaaagaagtcgaaaaaaacgaaatcaaacgcctcagcgatcgcctggacgccatccgccaccagcaggccgatctttcgctggttgaagccgcagacaaatatgccgagctggaaaaagagaaagccacgctggaagcagaaattgctcgcctgcgtgaagttcatagccaaaaactgagtaaagaagcacagaagctgatgaagatgccattccagcgcgcaattaccaaaaaagagcaggctgatatgggcaagctgaagaaaagtgttcgcggactggtcgttgtgcacccaatgaccgcactgggccgcgaaatgggcctgcaggagatgactgggttttcaaagaccgcgttttaagaacacagtatctacagggtgattctgcacattcctataggccgagtaaggtgttcacgccgcatccggcaagataaggcgctctggatcaacaacctaagggcaattctctgatgaggattgcccttttctttaccagacatctccccccacaagaattggccctaccaattcttcgcttatctgacctctggttcacaatttcccaattaaaactcacatcaatgttgccaatacataacatttagttaaccattcattgtcattatccctacacaacacaattggcagtgccacttttacacaacgtgtgacaaggagatgagcaacagactcattacacgatgtgcgtggactccaggagacctgcaatgaatctctggcaacaaaactacgatcccgccgggaatatctggctttccagtctgatagcatcgcttcccatcctgtttttcttctttgcgctgattaagctcaaactgaaaggatacgtcgccgcctcgtggacggtggcaatcgcccttgccgtggctttgctgttctataaaatgccggtcgctaacgcgctggcctcggtggtttatggtttcttctacgggttgtggcccatcgcgtggatcattattgcagcggtgttcgtctataagatctcggtgaaaaccgggcagtttgacatcattcgctcgtctattctttcgataacccctgaccagcgtctgcaaatgctgatcgtcggtttctgtttcggcgcgttccttgaaggagccgcaggctttggcgcaccggtagcaattaccgccgcattgctggtcggcctgggttttaaaccgctgtacgccgccgggctgtgcctgattgttaacaccgcgccagtggcatttggtgcgatgggcattccaatcctggttgccggacaggtaacaggtatcgacagctttgagattggtcagatggtggggcggcagctaccgtttatgaccattatcgtgctgttctggatcatggcgattatggacggctggcgcggtatcaaagagacgtggcctgcggtcgtggttgcgggcggctcgtttgccatcgctcagtaccttagctctaacttcattgggccggagctgccggacattatctcttcgctggtatcactgctctgcctgacgctgttcctcaaacgctggcagccagtgcgtgtattccgttttggtgatttgggggcgtcacaggttgatatgacgctggcccacaccggttacactgcgggtcaggtgttacgtgcctggacaccgttcctgttcctgacagctaccgtaacactgtggagtatcccgccgtttaaagccctgttcgcatcgggtggcgcgctgtatgagtgggtgatcaatattccggtgccgtacctcgataaactggttgcccgtatgccgccagtggtcagcgaggctacagcctatgccgccgtgtttaagtttgactggttctctgccaccggcaccgccattctgtttgctgcactgctctcgattgtctggctgaagatgaaaccgtctgacgctatcagcaccttcggcagcacgctgaaagaactggctctgcccatctactccatcggtatggtgctggcattcgcctttatttcgaactattccggactgtcatcaacactggcgctggcactggcgcacaccggtcatgcattcaccttcttctcgccgttcctcggctggctgggggtattcctgaccgggtcggatacctcatctaacgccctgttcgccgcgctgcaagccaccgcagcacaacaaattggcgtctctgatctgttgctggttgccgccaataccaccggtggcgtcaccggtaagatgatctccccgcaatctatcgctatcgcctgtgcggcggtaggcctggtgggcaaagagtctgatttgttccgctttactgtcaaacacagcctgatcttcacctgtatagtgggcgtgatcaccacgcttcaggcttatgtcttaacgtggatgattccttaatgattgttttacccagacgcctgtcagacgaggttgccgatcgtgtgcgggcgctgattgatgaaaaaaacctggaagcgggcatgaagttgcccgctgagcgccaactggcgatgcaactcggcgtatcacgtaattcactgcgcgaggcgctggcaaaactggtgagtgaaggcgtgctgctcagtcgacgcggcggcgggacgtttattcgctggcgtcatgacacatggtcggagcaaaacatcgtccagccgctaaaaacactgatggccgatgatccggattacagtttcgatattctggaagcccgctacgccattgaagccagcaccgcatggcatgcggcaatgcgcgccacacctggcgacaaagaaaagattcagctttgctttgaagcaacgctaagtgaagacccggatatcgcctcacaagcggacgttcgttttcatctggcgattgccgaagcctcacataacatcgtgctgctgcaaaccatgcgcggtttcttcgatgtcctgcaatcctcagtgaagcatagccgtcagcggatgtatctggtgccaccggttttttcacaactgaccgaacaacatcaggctgtcattgacgccatttttgccggtgatgctgacggggcgcgtaaagcaatgatggcgcaccttagttttgttcacaccaccatgaaacgattcgatgaagatcaggctcgccacgcacggattacccgcctgcccggtgagcataatgagcattcgagggagaaaaacgcatgattatttccgcagccagcgattatcgcgccgcagcgcaacgcattctgccgccgttcctgttccactatatggatggtggtgcatattctgaatacacgctgcgccgcaacgtggaagatttgtcagaagtggcgctgcgccagcgtattctgaaaaacatgtccgacttaagcctggaaacgacgctgtttaatgagaaattgtcgatgccggtggcactggctccggtgggtttgtgtggcatgtatgcgcgtcgtggcgaagttcaggcagccaaagcggcggacgcgcatggtattccgtttactctctcgacggtttccgtttgcccgattgaagaagtcgcgccagccatcaagcgcccaatgtggttccagctttatgtactgcgcgatcgcggctttatgcgtaacgcgctggagcgagcaaaagcagcgggttgttcgacgctggttttcaccgtggatatgccgacaccgggcgcacgctaccgtgatgcgcattcaggtatgagcggcccgaacgcggcaatgcgccgctacttgcaagcggtgacacatccgcaatgggcgtgggatgtgggcctgaacggtcgtccacatgatttaggtaatatctcagcttatctcggcaaaccgaccggactggaagattacatcggctggctggggaataacttcgatccgtccatctcatggaaagaccttgaatggatccgcgatttctgggatggcccgatggtgatcaaagggatcctcgatccggaagatgcgcgcgatgcagtacgttttggtgctgatggaattgtggtttctaaccacggtggccgccagctggacggtgtactctcttccgcccgtgcactgcctgctattgcagatgcggtgaaaggtgatatagccattctggcggatagcggaattcgtaacgggcttgatgtcgtgcgtatgattgcgctcggtgccgacaccgtactgctgggtcgtgctttcttgtatgcgctggcaacagcgggccaggcgggtgtagctaacctgctaaatctgatcgaaaaagagatgaaagtggcgatgacgctgactggcgcgaaatcgatcagcgaaattacgcaagattcgctggtgcaggggctgggtaaagagttgcctgcggcactggctcccatggcgaaagggaatgcggcatagtcgtttgcgccccctcaccctaaccctctccctcagggagaggggaccgttcggcgctgtatgtactccctcactctgaaacgacaccgcactctttttttctccctcgcccctccggggagagggccggggtgaggggaaaaggccgcactgctcaccaattttctgctatcctgcccccgcactaagggggcagtatgctaaacatcgtactttacgaaccagaaattccgccaaatactggcaacatcatccgtctttgcgctaataccggctttcgtctgcatatcatcgaaccgatgggatttgcctgggacgataagcgcctgcgccgcgcggggctggactatcacgagtttaccgccgttacgcgtcatcatgactatcgcgcgttcctcgaagcagaaaatccccagcgcctgttcgccctcaccacgaaaggtacacctgctcacagcgccgtaagctatcaggatggcgattatctgatgttcggcccggaaacacgcggcctgccagcgagcattcttgatgccctgcccgctgaacaaaaaattcgcattccgatggtgccggacagccgcagcatgaatctgtccaatgcggtgtcggtagtggtgtatgaagcctggcggcagttggggtatccgggagcggtattgagagattagttactgtaggccggatagatgattacatcgcatccggcacgatcacaggacattagatcccatccccatactcaaatgtatggttaataccgttgaaatgctggtccatatccattgatggcttatcgctgtctggtttaccgacaatacgagccggaacgccagcggcggtggtatgcggcggcaccggttgcagcaccacggaacctgcgccaatcttcgcgccgcgcccaacttcaatattgccgaggattttcgcgcccgcgccaatcatcacaccttcacgaattttcgggtgacggtcaccaccagatttacccgtaccgccaagcgtcacagattgcagaatcgatacgtcgttttcaatcaccgccgtttcaccaacgacgatgcctgtcgcgtggtcaagcatgataccgcgaccaatttttgctgccgggtgaatatcgacctggaacgtcacagaaacctggttttgcagaaagattgccagtgcgcgacgcccctgattccacaaccagtgaccgatgcgataggcctgcaaggcatgaaaacccttcaggtataacaacggggttgagtatttatcgactgccgggtcgcgggtacgcaccgcctgaatatcacaggccgcagaggcgatcatttccgggtcagcggcgtaggcttcttccaccacttcacggatagcaatagcaggcataattggcgatgacagcttgttcgccagcatgtagctcagtgcactgccaaggttttcgtgcttgagtagcgtcgcgtggtaaaaactggccagcattggctcacagtccgccagcgttctggcttcggctttaatattgttccagacaatttccagttcttcacacgacattgcttactccacacgatgagataatgaccggcccgttctgcgcgggccgggtcatagcggtaacaaaggttccctggggttagtggctgctgcgctcgtccttgcgtgcacgacctagtaaagtcaatgctgcctcgcgcgcgttttttccgcaatataatacttgataaatttcctcggttattggcatttcaacgccgaagcgatgcgccagttcgcggacttctttcgtattgcggtagccttccaccacctgaccaatcttctcctgcgcgctttgtacatccatgccctgaccgagcatcatgccaaaacggcggttacgcgactggttgtcggtacaggtaagcaccagatcgccaagccccgccatgcccataaaggtggcagggtcggcacccagcgccgcaccaagacgcgacatttcagccagcccacgggtgatcagcgccgtacgcgcattcgcaccaaaaccgataccgtcggacatccccgcaccaatggcaataacgtttttcaccgcgccgccaagctgcacgccaatgaaatccggattgctgtaaacgcggaaacttttgccgcagtgcagcagctgctggagatcatcggcaaaggtctgatcggtcgaggccagcgaaatagctgtcggtaaacctgccgccagttctttcgcaaacgttgggccagagataaccgccagcggaatttgatcgcctaaggcctcacgcgccacgtcctgtaacagacgtccggtttccgcttccagccctttggtcgcccacaccagacgcgcatcaggacgcatcagtggtttaatctggcgcagcacttcaccaaagacatggctgggtacgacgacgagaatattacggctggctgccagcgcagtggcgagatcgctttcaagatggagcgtatcgggaaaaggcacatcggggagaaacgcggcgttacagcggtcgcgttcaagcgttgcgatatgttcagggtcatggccccagaggacaacctcgtggccatttcttgccagggtgatggcaagagcggtgccgtacgagccggcaccgatcacagtcattgaagcattacgttggttcatcaggcatcctgatgttcttcagtaccttcgccagcctgctgctgcaaatagttcatgaacagcgcatcgaagttaaccggcgcaaggttcagttgcgggaatgtaccgcgggataccatgctggtgatgcactcacgagcatacgggaacagaatgttcgggcagtatgctcccaggcaatgcgccatctgggtgccttcgatacccgcgatggagaaaataccgccctgctgaacttcacacaggaacgcggtttcttcgcccaaagaggccgttacggtaacacgcagtaccacttcgtatacgtcatctgccagttgggaagatgccgtatccagatcaagtttaacttctggttgccaatctttctggaaaacgtgcggcgcgttcggcgcttcgaaagagatatccttggtataaatacgttggatctggaaagtcatttcagtgttgttttgttctgacatgtgtagaaaacccttaagtgttgtccttaaatactgcgcaatgtaatgccaacgttcacacgttatttcagcaggggatccagtccaccacgtgcatccaatgcatacaagtcatcacagccgccaatgtgctgtgcgtcaataaaaatctggggaaccgtggtgcgaccgctgcgtttgatcatctcttcacgcttggcggcgttgccatcgatcggcagctcctggaaactcacgcccttgctgctcagcagtgcttttgcacgatggcaatacgggcaggtttctttggtatagatttcaacattggccataaattagctcctgtttttttaccctgaaatttcatgttgcagggcggcagcaaaatggagtgtccccagaagcttataacaataagtcgctgggggcctaattgcagctaacggcctgcatcatgaaagacgacaggtaaattatttgccgcgcaccaaaggcaagttttcgccagcccagccagcgacgccttctttcagcacgaatacttgcgcaaaaccagctttcgtcagtgcgtttgcaggctcctggcactgcatgccagaaccgtctaccacgataaccggtttgtctttgtgcttctcaagctcaccaacattgttggctttgatttcgctcggcaacagattaatagaacctgcgatatggcctttacggaagtcatcacgctgacgtaaatccacaaccacagcgtcttctttgttgatcagacgcgtagcttcaccacgagtaatcaccttcactttcgaggtcaggctcttaaacgtagtcacaagaaccgccaccagtaacgcgatccaggcgatactcagtatgggatgacggccaacaaattgcataatttcttgcatggggggtaacaactcccgacgtagtgattaaaaaaaccaggaaaggagtatacctgcgcggtgcggcaaatacagccagcgcgttaactggaatgcaattttgcggggcgcgacgaaaaaaaagcgtaaatctggcatcggcttgccgcgagcggtcgtatattttgatcttcagaggctattttatcgattcagctgtagtaaaattacgcaaattttgactcttgagtatgaggttgtcgcaatgttggtttctaaaaaacctatggtactggtgattctggatggctatggctatcgcgaagaacagcaggataacgccatttttagtgctaaaaccccggtaatggatgcactgtgggccaatcgtccgcataccctaatcgacgcttccggtctggaagtcggtctgcctgaccgtcagatgggtaactccgaagtaggccacgttaacctgggtgccggccgcatcgtgtatcaggacctgactcgtctggacgttgaaatcaaagatcgcgctttctttgctaatccggtgctgactggcgcggtagataaagcgaaaaacgcaggcaaagcggtacacattatgggtctgctctccgcaggcggcgtacacagccacgaagatcacatcatggcgatggtagaactggcagctgaacgcggcgcagaaaaaatctacctgcacgcattccttgacggtcgcgacactccgccgcgcagtgctgaatcctcgctgaaaaaattcgaagaaaaatttgccgcgctgggcaaaggccgcgtagcgtccatcattggtcgttactacgcgatggaccgcgataaccgttgggatcgcgtagaaaaagcttatgacctgctgactctggcgcagggcgagttccaggccgataccgccgttgctggtttgcaggctgcttatgctcgcgacgaaaatgatgaattcgtgaaagcgaccgttatccgtgctgaaggtcagccagacgcggcaatggaagacggcgatgcactgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgccgctgacatcaaaactgcggttgcttacccacccgcttccctggttaacaccttcggcgagtggatggcgaaaaacgacaaaactcagttgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggccatcaagagcggcaaatacgacaccatcatctgtaactatccgaacggcgacatggtaggtcacaccggggtgatggaagcggcggttaaagcggttgaagcgctggatcactgcgtggaagaagtcgcgaaagcggttgagtccgtgggtggacaactgctgatcaccgctgaccacggtaacgctgagcagatgcgcgatccggcaacgggtcaggcacacacggcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataatccctccccatgaggggaaaggcgattaataccatgacacgggccgtgaaaccgcgcaggtttgcaatcaggcccatcatctacgccagcgttcttagcgctggcgtattgttgtgcgccttttccgcccacgcggatgagcgtgaccaactcaaatctattcaggctgacatcgccgcaaaagagcgcgcggtacgccaaaagcaacaacaacgcgcaagcctgctcgcacaattgaaaaagcaggaagaagcgatctctgaagccacccgtaagctgcgcgaaacgcaaaacacgctcaatcaactcaataaacagattgatgagatgaacgcgtcgattgccaaactggagcagcaaaaagccgcccaggagcgcagcctcgccgcacaactggatgccgcattccgtcagggcgagcataccggtattcagctgattctcagcggtgaagaaagccagcgtggacagcgtttacaggcttatttcggctatctcaaccaggcgcgacaagaaaccattgcccagttgaagcaaacgcgtgaagaagtcgccatgcagcgtgctgaactggaagagaaacagagcgagcaacaaacgctgttatatgagcagcgcgcccaacaggcgaaactgactcaggcgctgaacgagcgtaaaaagacgctggcagggctggagtcttccatccagcaaggtcagcaacagttgagcgagctgcgcgccaacgaatcccgtctgcgtaacagcattgcccgtgcggaagccgcggcgaaagcgcgtgcagaacgagaagcacgtgaggcccaggcggttcgcgaccgccagaaagaagcgacgcgcaaaggcaccacctacaaaccgaccgaaagcgaaaaatcgctgatgtcccgtaccggtggtctgggcgcgccgcgtggtcaggcattctggccggttcgcgggccgacgctgcatcgctatggcgaacagctacagggtgaattacgctggaaaggtatggttatcggtgcttctgaaggtactgaagttaaagcgattgccgacggtcgggtgattctggctgactggctgcaaggctacggtctggtggtggtggttgagcatggtaaaggcgacatgagtctttacggctataatcagagcgcactggtgagcgttggttcgcaggttcgcgcgggccagccgattgcactggtgggcagcagtggcggtcagggtcggccttcactctatttcgaaattcgccgccagggtcaggcggtcaatccacagccgtggttgggaagataagttttgtttccatttcgtcgtaacgttcttgcatttgccgctctgttggcgctctcctcccccgtacttgctggcaaacttgccatcgtcattgatgattttgggtatcgcccgcacaacgaaaaccaggtgctggcgatgccttccgctatctccgtcgctgtattacccgattcaccgcacgccagagagatggcgaccaaagcgcataacagcgggcacgaagtgttgattcatctcccgatggcaccgttgagtaaacagccgctggagaaaaatacgctacgcccggagatgagcagcgacgaaattgagcgcattattcgtagtgcggtcaataacgtgccctatgccgtggggatcaacaaccacatgggcagcaagatgacctctaacctgtttggtatgcagaaagtgatgcaggcgctggagcgttacaatctttacttcctcgacagcgtaaccatcggtaatacccaggcgatgcgcgccgcgcaaggcactggcgtgaaggtgatcaaacggaaggtattcctcgacgattcgcaaaatgaagcggacatccgtgtgcaatttaatcgcgcaattgacctggcgcgtcgcaacggttcgaccattgccattgggcatcctcaccctgcaacggtacgcgtgttgcaacagatggtttataacctgccgccagacattacgctggtgaaagccagcagcttgctgaatgaaccgcaggttgatacttctacaccgccgaaaaacgctgtgcctgatgcaccgcgtaatccgttccgtggcgtgaagctgtgcaaaccgaagaaaccgatagaacctgtttatgctaatcgcttctttgaagtattaagcgaaagcatcagccagagcacgctgatcgtttacttccagcatcagtggcaaggctggggcaaacagcccgaagcggcgaagtttaacgctagcgcaaattaaaggcgctacgcgtaatgcgatggtgcgaccgcgttttgtcgcgccattgccataagcggaaagaccacagtaacgcctggtaaccgaccttcacgctgcgcacattggtaatcaggcgcttatacataccggaagtaaatatctcggcaatcatccgttggcgggtaagaatatccggctctttgcgcaccgcatggcaaacacgcaatgcctcgtaagttatttgctgatgaaattccggataaatcataattttgtcggcataatttcgatttaatttctccagcaggcgggtaatcttaatatagtgacgttgataattaaggtttttattcccttgtctatgcaaccgactcactgacgtattatgcagataatatttatataatgattgctcggtatatcgcgcacgcagcgcgttaaacatgaattctgttgtccagacaatatcctgatgatgtaatccggcaataaatttaatgttatttttaacaataacatcacggcgataaacccccatccagacaacgtgagtccaacggcgcgaagaaagccccatccgcagccagtccgggccggttaatacgccggttgagcgaaggcgatcggtggggatggattgccaggtttctcccgtttcacgaaaacaccagtcagcgttgcactgcgccacgtcgaggtcgtcctctaacgccatggtcatcagcgtttcgtacatggtgggatagacttcatcgtcagcatcgacaaaagcgacatatttgcccgttgccacttcaatcccacgattacgcgccaccgatgcgccagcattcgcctgatgcaacaaacgaacgtgcggatagttttctgcgtaatactttgctatttcaacagaattatccgttgaaccatcgttaataataatgatttccagagcagtccaggtttgcgtaattaaagattccatacaagtgcggaaatcatcgcccgcattatataacggaataataacactaagtttattggtgctgttcatcataaattaccgacgacctctgaagttatcctgacgttttacaggctttgtattaagaaactattaagcctgtgagatattatttttacaggtgagagagtcacttcagggtagagagataatgagagcagctatataagagatcagcacaattacgaactctttattacactgacaggattttacatatttaacagattatcctcagataaaagggctggaataccagcccttgttcgtgttaatcccagctcagaataactttcccggactggcccgaacgcatagcgtcaaagcccttctggaaatcatcgatagagaaacgatgggtaatgatcggcgaaagatcgaggccagactgaatcagcgccgccatcttgtaccaggtttcaaacatctcacgaccgtaaatacctttaatgaacaagcctttaaagatcactttggtccagtcgatagacatatcagacggcggaatacccagcatcgcaatacggccgccgtgattcatggtgtcaagcatggtacgaaacgctggcggcgcaccggacatttccagaccgacatcaaaaccttcggtcatgcctaactccgccatcacgtcattgagattttctttggcgacgttaaccgcacgggtgatacccattttacgcgccagctcaaggcggtattcgttaacatcagtgatcaccacattgcgtgcaccaacgtgtttcgccaccgccgctgccataataccaatcgggcctgcaccagaaaccagcacatcttcgcccaccagatcaaacgacagcgcggtatgcacggcgttaccgaagggatcaaaaattgcggctaagtcatcggaaatattgtcggggattttgaaggcgttgaatgccgggatcaccagatattcggcaaagcagcccgggcgattaacaccaacgcctatcgtgttgcggcacaaatgggtacgaccaccacgacagttgcggcaatgaccacaggtgatatggccttcgccagaaacgcgatcgccgatcttgaagcctttcacttcctgaccaatacctaccacttcaccgacatattcatggcccacgaccatcggcaccgggatggttttttgcgaccactcatcccagttatagatgtgaacgtcagtcccgcagatggctgttttacggattttaatcagcagatcgttatgcccgagttccggtacaggaacgtcggtcatccagatgccctcttccgctttcagtttggataacgctttcatctcacatcctcaggcgataacgcccagttgtttaccaatacgcgtaaatgcttctactgcacgcgtaatttgctcaggggtatgcgccgcagacatctgggtacgaatacgcgcctgacctttcggaacgaccggatagaagaaaccggtaacgtaaatgccctctttttgcagctcacgggcaaatttctgcgccactaccgcatcaccaagcatgaccggaataatggcgtgatcggctcccgccagggtaaagcccgccgccgacatttgctcacggaactgacgcgcgttcgcccacagacggtcacgcagttcgctgcccgcttcgaccatctccagtactttgatggacgcggcaacaatggccggtgccagcgagttggagaacaggtacggacgagaacgctggcgcagccactcaaccacttctttgcgcgccgcggtataaccaccagaagccccgcccagcgctttaccaagcgtaccggtgataatatcgacccggcccatcacatcgcagtattcatgggaaccacgaccattttcaccgacaaaaccgaccgcgtgggagtcgtctaccatcaccagggcatcatatttatctgccagatcgcaaacgcccttcaggttggcaatcacgccgtccattgagaacacaccatcggtggcgatcagcacatgacgcgcaccggcttcacgcgcttctttcagacgtgcttccagctcctgcatatcgttgttggcatagcgatagcgtttagctttgcacagacgcacaccatcaataatagacgcgtggttcagtgcgtcggagataatggcgtcttccgcacccagaagcgtttcaaacaggccaccgttagcatcaaagcaggaagagtagagaatcgcatcttccatccccaggaaggccgccagtttttgttcaagctctttatggctgtcctgagtgccgcaaataaaacgcaccgaagccatgccgaaaccgtgagaatccattcccgcctttgccgccgcaatcagatcaggatgattcgccagcccgagatagttgttggcacaaaagttaatgacgtggcttccatcagccacagtgatatctgcttgctgcgcagacgtaataatgcgctcttctttaaacaacccttccgcccgtgcggtttccagatcgttggttaactgctgataaaattctccacgcattgcgattctccagacagggcaaattccagcacatattacccaaacttataggtcgcgacgagataacgcgttaacacttctgcaaaattcaggataaataacgtgtaacttgatgtctctcaacacctacagatagtagaaaaactgtacagttttggctgggcataatgatgattgattttactgcattgatataaaaagaaaaaatgatgccaaagcatcatttttcctatctcagttggtatcaaaacgctacccactaatggagggaaacctattttcttgaaaggaaaattctcagcgcctgcatttttgcccctaaagtgttactcctgaagcagcgaaacaaatcgaaccattttcctctccccagatagtttaggttgaagagatcggggcgtttgtaatagcacatgacaaaaatgccctggtcatcgtccacaatgttattatttagtgttattttttgactttccagaactaatttatagaattctttccatttatgctgtgaaccaacaattgcgcccccaataatatatacatgattgccaatcatgaaatcaaaaacctgttgttgagatgtgacagtaagccctttttttatagtgaaaagatgcatcttactttcatcaaatgggaaatcccaaattttcaatcctcgagttacatttggcttatggcaatagccaaaatctatccacgcaacaagaggcgttttcactaagcccatgttgatagctttatttacaaaataggccttaaggttacataccaaaacatactctggtgaccagtactctgggttttttaattgtcgaggctcaagtctatttgtaaacgactcatctttttgaattttttcgatacgacttctgatatatctaaatttcttttttatatcgataacgataaccgttgttggttttccgttgcgaatcgcttcaacccttggtttcaaatcgggagaagtgaaaataatcatctcattttcaagtgcggccagacgctcaaagtaactaaaataaacatcaactgaacgagctagtttttcacggaaccctttattagcagtccaatcccctctaccaatgtcaaaatatgcagtgataattgtggtggatgatttcattactaataagaccattaatataaaaaaagaattatatcataaatattaatagaatgtatactgtatattatccattcaaatgcttccgttatttatcatacatcggaatattgatactaaagcactattcacatgcaaaaccaacatccgccatgaaggactagctaaaacccaaactagtttgttgcaattagcatccttgcacctctatgtaaagggctgaagggattcggatgtgatggtatgattacagacattcgtgtctgagattgtctctgactccataattcgaaggttacagttatgatcatcgttaccggcggcgcgggctttatcggcagcaacatcgttaaagccctgaatgataaaggcatcaccgatattctggtggtggacaacctgaaagacggcaccaagtttgtgaacctggtggatctgaatatcgcagactatatggataaggaagacttcctgatccagattatggctggcgaagagttcggcgatgtcgaagcgattttccacgaaggcgcgtgctcttccaccaccgagtgggacggcaagtatatgatggataacaactatcaatactccaaggagctgctgcactactgcctggagcgtgaaatcccgttcctgtacgcttcttccgcagccacctacggcggacgcacctccgactttattgaatcccgcgagtacgaaaaaccgttgaacgtctacggttactcaaaattcctgtttgatgaatatgttcgtcaaatcctgcctgaagcgaactcgcagattgttggcttccgttatttcaacgtttatggaccgcgtgaaggccataaaggcagcatggcgagcgtcgctttccatctcaacacccagcttaacaacggtgaatcaccgaagctgtttgaaggtagcgagaacttcaaacgcgacttcgtctatgtgggcgacgtggctgatgtgaatctgtggttcctggaaaatggcgtttccggcatcttcaatctcggtactggtcgtgcggaatccttccaggcggtagctgatgctacgctggcttatcacaagaaaggccagatcgaatacattccgttcccggataaactgaaaggccgctatcaggcgttcactcaggcagatctgacaaatctgcgcgcggcgggttacgacaaaccgttcaaaaccgttgctgaaggtgtaacggaatacatggcctggctgaatcgcgacgcataagagctctgcatgaaaatactggtgatcggcccgtcttgggttggcgacatgatgatgtcgcaaagtctctatcgcacgctccaggcgcgctatccccaggcgataatcgatgtgatggcaccggcatggtgccgtccattattatcgcggatgccggaagttaacgaagctattcctatgcctctcggtcacggagcgctggaaatcggcgaacgccgcaaactgggtcatagcctgcgtgaaaagcgctacgaccgcgcctacgtcttacccaactccttcaaatctgcattagtgcctttcttcgcgggtattcctcatcgcaccggctggcgcggcgagatgcgctacggtttactcaacgatgtacgcgtgctcgataaagaagcctggccgctaatggtggaacgctatatagcgctggcctatgacaaaggcattatgcgcacagcacaagatctgccgcagccattgttatggccgcagttgcaggtgagcgaaggtgaaaaatcatatacctgtaatcaattttcgctttcatcagaacgtccgatgattggtttttgcccgggtgcggagtttggtccggcaaaacgctggccacactaccactatgcggagctggcaaagcagctgattgatgaaggttatcaggtggttctgtttggctcggcgaaagatcatgaagcgggcaatgagattcttgccgctttgaataccgagcagcaggcatggtgtcggaacctggcgggggaaacacagcttgatcaagcggttatcctgattgcagcctgtaaagccattgtcactaacgattctggcctgatgcatgttgcggcggcgctcaatcgtccgctggttgccctgtatggtccgagtagcccggacttcacaccgccgctatcccataaagcgcgcgtgatccgtttgattaccggctatcacaaagtgcgtaaaggtgacgctgcggagggttatcaccagagcttaatcgacattactccccagcgcgtactggaagaactcaacgcgctattgttacaagaggaagcctgacggatgcgggttttgatcgttaaaacatcgtcgatgggcgatgttctccatacgttgcccgcactcactgatgcccagcaggcaatcccagggattaagtttgactgggtggtggaagaagggttcgcacagattccttcctggcacgctgccgttgagcgagttattcctgtggcaatacgtcgctggcgtaaagcctggttctcggcccccataaaagcggaacgcaaagcgtttcgtgaagcgctacaagcagagaactatgacgcagttatcgacgctcaggggctggtaaaaagcgcggcgctggtgacgcgtctggcgcatggcgtaaagcatggcatggactggcaaaccgctcgcgaacctttagccagcctgttttacaatcgtaagcatcatattgcaaaacagcagcacgccgtagaacgcacccgcgaactgtttgccaaaagtttgggctatagcaaaccgcaaacccagggcgattatgctatcgcacagcattttctgacgaacctgcctacagatgctggcgaatatgccgtatttcttcatgcgacgacccgtgatgataaacactggccggaagaacactggcgagaattgattggtttactggctgattcaggaatacggattaaacttccgtggggcgcgccgcatgaggaagaacgggcgaaacgactggcggaaggatttgcttatgttgaagtattgccgaagatgagtctggaaggcgttgcccgcgtgctggccggggctaaatttgtagtgtcggtggatacggggttaagccatttaacggcggcactggatagacccaatatcacggtttatggaccaaccgatccgggattaattggtgggtatgggaagaatcagatggtatgtagggctccaagagaaaatttaattaacctcaacagtcaagcagttttggaaaagttatcatcattataaaggtaaaacatgctaacatcctttaaacttcattcattgaaaccttacactctgaaatcatcaatgattttagagataataacttatatattatgttttttttcaatgataattgcattcgtcgataatactttcagcataaaaatatataatatcactgctatagtttgcttattgtcactaattttacgtggcagacaagaaaattataatataaaaaaccttattcttcccctttctatatttttaataggcttgcttgatttaatttggtattctgcgtttaaagtagataattcgccatttcgtgctacttaccatagttatttaaatactgccaaaatatttatatttggttcttttattgttttcttgacactaactagccagctaaaatcaaaaaaagagagtgtattatacactttgtattctctgtcatttctaattgctggatatgcaatgtatattaatagcattcatgaaaatgaccgcatttcttttggtgtaggaacggcaacaggagcagcatattcaacaatgctaatagggatagttagtggcgttgcgattctttatactaagaaaaatcatccttttttatttttattaaatagttgcgcggtactttatgttctggcgctaacacaaaccagagcaaccctactcctgttccctataatttgtgttgctgcattaatagcttattataataaatcacccaagaaattcacttcctctattgttctactaattgctatattagctagcattgttattatatttaataaaccaatacagaatcgctataatgaagcattaaatgacttaaacagttataccaatgctaatagtgttacttccctaggtgcaagactggcaatgtacgaaattggtttaaatatattcataaagtcacctttttcatttagatcagcagagtcacgcgctgaaagtatgaatttgttagttgcagaacacaataggctaagaggggcattggagttttctaacgtacatctacataatgagataattgaagcagggtcactgaaaggtctgatgggaattttttccacacttttcctctatttttcactattttatatagcatataaaaaacgagctttgggtttgttgatattaacgcttggcattgtggggattggactcagtgatgtgatcatatgggcacgcagcattccaattatcattatatccgctatagtcctcttactcgtcattaataatcgtaacaatacaattaattaagaataaacaagtttaagaagtgagttaaaactcacttcttatctatacaacttaatctctttactgaattagttaaagtttcagtatcgatatcttttaccgtatatgttggggatactatttgtatagatttatgatgattcggggaccaaattaaatgcgagggatattccggagtacgtgaattagggtaaaatgcaagcgttggtttatgataagccgcagcgatatgaacaagagctgtatcaacagaaatgacaaaatcactatacttggtcaacgcaacggtataaataaactcatcaaatggtagtgtttcgatttcaagtattggtattgtcaataaatcttgcggtaacccggtaaatataatccgataattttcaaagtgtgttttcacttcttgatatataacttttatttgctcaaacgtaagacggcatattttttttgcacctaatggattaataatgactattcttgtatctccaataaattcttttattttatcttcaacatctactggtaaatgcaagtcgtagttggtggaaaatttaccctcaccataaatatgcttcagtatttctattgctcgtgtactcatatgttcttttaaacattcatcgtggggatggtaaaatgaatagtaacgcttataccaatgatcaaaacccagaatgtaagaatcttttaaacttgataatattaagctatgcttaaatgagggcatagtttcaaaggggtctaatacaatatcgaactgtaaatcccgcagatgcttacatagagtaagcatttcaagaaaaccggttgattctttaatacagaactcaaatatatttttattattagagagaaattccccaccctttctatttgtgagaagagttattttaacccctttactataaagttcacgataaatcgaacttaatacaattagatcaccaagtttattattatcatgaataataaggcatgatttaacttgtgctggatctgtaatttgattatttattttattacgaaataaaaaagaaaggaaattaatcttgattttgtttatataaaatcttttctttttgtgaaaagttcctaagcgcatttttataccatattattttagtttcaggatgattaattagcataagaatcggttgaagttctatattgcattttttttcttgtcatatcttttgattcttctgcactgatgtcttgaagtttaataaatggaattacatcgtaagaaatagctgtatcatctgataaattataaatattaatatcttttacattatcatgcataaaacgaaaaaatggcaatattttgaataaatccctacttaattccgagggcatgggatttttattctcatcatagaaacgagaacagctacccgttaaatcaagaccagaacaaataatccgcgcatacttaagtgaatatgcgatttgaattgcagcaaaggcaatagtatggcatgagcaataaccaagactaatgtccttgcaaaatccaaccagacgaccttttttagacaacggtacagagatcagcagttctttgtgaatctgtctcaaaatattaaatttaatcttctttataaaaccacctttttcccgacggtaaaaggaccgtaatacgaggcagttctggaggatataaagtttatcttctttggaagcgtgttcataaacgtcaacgtttactatggtataacgacttctctggctaaatttataaaaatcatcacgacgctgatgtaaaaatcggacatctgtaagtacatatataaaaggaacgatattattacttaacagatattgcgcagaaccattgacagcaataatatcctttgttcgtaatactgacaaaggtgttttttgcgatgtagggcccgaaagaaaaataataacatcatcagatattttattttcaatcaggttttcaacatcttttttgtcaatgtatctaatattcttcatgataaacctgtgaaataaataactccgcttaaaactgtcctggtgaagacatgtaattgtgggattttttttagcgcgctggtttccctttcaaacgccgcataaaattgcgcatttttttacgatatactaaaagataatagcctagatctctaatctcatttttaataccgtaatgacgctctaagtcaatacgatctttcgctttacgctgcgctgaagcacgctttccggagagatcgataattcgaacctcaccattttttataatgaagttaccacgatgggggtcgccagaaaccatgccatgttgatgtaaggcattaattgattgctgaattttattttttagcgcatcatcaatatcgggcatatcacacaactctatgccatcaatatactcgatgatcatgatataagtatggacaaaacgtaaggttttccgttcagccaataaataaaagtcattgagtgtatttaacccttcatttcgtactttttgggtttgctcaaaaaggcgttcgtaataatcaccttttaacagagacttaaagaaacgttcgttacgcttaactttcggagaaaaaaccttaagaatcaatttaccgtaatcggtatcaataagcataacttttgtatcatcaatagaacgaaaaaccttgatgatatttatattataagacaagaagtcatttaatacattgaggtactttgaattgttttcatcggtaaaaacaaccaagtctttgatcttgctcttctgaatcataataaaccagttaaatgttatttacggtaatattttcggcaaagataacagactcctgctataattcctgagatataatgatgttgcactaaaagatgtttatatctttttttaaattcaataattgatttcgcatctcgtggagagtcatctttccagggggaattttctaaagctattttatagtattttaccgatggataaattgcccatttgtgccacggtttagttgcacctgtataatgaataagaagagtactttctgtaatcagctttttatagttttgatgtgttttgtcttttaattcacttttaattgtataaattgtattgtactcacgaggcaaaaataatgtcatccctttcagtaagacattcataacatcctgatcagggtatttataaacattatctttactcataagaatagacaacgctttttctgttagttttgcgtcagcccatttttttaagtctaaataaacgacaccggaattaaagtactgcccaagtaattcaggatcagacaacctggataccgccttttcttgcattggctcaacatctttaacaacagcagcaaccgctccatttaaacccagatgtaatagttggctaatatcgcctttacaaacaacatctgcatcaagataaagcaaacgatcaagcgttaaacccaataattgaaatgcaaataaacggaagtacattgctcttgaccagacctgtgtacaaggcaagcactggagcttatcagtgttaattctatataacgtgattcttaattggttttgctctgcaagctttgcaattttttgaaaaaaaccatcattataaacatcagcaataatataaaaatcaagattaatatgtcgattatttaggacaattgatgtgatggaaacacctacaccatcaagataattagcatcgacaccataggcaacatttaaacattcagaagtatttatattagctagccgaaaatcccaggctttaactttatctatctctatggcaggaaatgagtccacaatgctacccttatatcattactttatagtttcccagttttaatgctttatcttttcaataaaataaaaaagatagttgctaaatccttttagatatctatgctttttaagcatatgttttgcgctatatcttaattgattgctattgttcggtttcagcaacgccgtattcttccatggcgaagcattttttgcctccataaaggcttgtgatacaggataatcccaggcccaatcatgccagggcttggttggcccgatataatggataaaaatagtatcgttggttactgggtttataaagctttctttgagttgataatttaagctgaactgggtgttatatttaatatcagcgaaaataagtttatccgccagcaacatatttaacacatcctgatcaggatgtgttatttttttgattatttctggctcatttagcattgcaatagctcgtgcagaaacctgctgagccgcccattgggcagtattaatcaataaaaaaccggagttaaagtaacctttagcaattcccgcaacacctaacgaatgggcgcgtttttcccaccagtcagcttgcccttctgtaacaaccattgcgactttatcgtcaggaaatgagaaattaattagtggctcaatagtcccctgacaaatgatatctgcatccagataaaggactttaggcgccttattaataaagtaatctgcaataacaaaacgaaaatatattgcatgagtccaattcttagtgctaggcaatgagcgcagtcgatcaccattaatcagatatattttaattctggttttatactgcaacgccagggcatcaaaatacttacgatcatcatcaccaaaataatcagtaaaaatatggaaacacaatcgacttccttcattatattttaatattgaagcaatcgaaattccgcaaccaaatagaaagtttttgtcagttccataagcgatgtccagacaaagattttctgtttctactttatgatcataatcaataactgaattaagaaactcagtttcctggaaaaacacctgctgcattatttcctccgggaaatagcagaaataattaccttatgtaatctatcgtaatacttcgattggtaaaattcatcgatcgacgcaggaattttttcatgttcgatatgaatttcacctgctatatatttatttagaagagttacaaaaccagcaatatctcccggttgatacagatggccattgacatcaggttgaataatgtcagcaggcccggagacacaatcggcactgatacaaggaatcccccacgacaaggcttcaagtagggtcattgggaaaccttcaaaagatgacgtgagcaataacgcactcactttttcaatatcttgctggaccaattcccagggatattgttgccaaccataccagacaattcgatcatcaatatttaattctctaccataagcctggcatttttcgaaatcggagccatcacccaatacatggagtttccagttacctttcgcttgtgataagccatcaagcaggtctttaactcttttctggccttcaaatttcatacgcccaacataaataaacgttgccgtttcaccttcctcgggcgcgggaatgactgagtctttagtttcgacgggattaaaaataacatttatcgtcgattctgctacacctcgattaatcatttgctgtttaatgccagagctgattgctaaatgatagtcggcacaggtgatatattcagcatgttttttgtgatctaaagaaaaatgtggccatgaaaatactggcatatcaattcctgattttttacgtgcttttgcggcaaacaggcaggagatcacatcaatacaaataacgatatctggttggtactcctgaagccatttacttagagcatgaatatgtttcgcccgacgcaaaaaacctaaacgaatattggaaaatgaacatgagtatttaataccttccagccatcccttatccattttgtcattacgacaaaagaaaaacatttcactttggatatgttgttgcctgaaggtagtaataacatcacggatgacagtttccatgccgccaaatccagaaacagcttcgccgataaacgctattttcatagaaactctcattaattgagtaaaactcactgttttaacggttttatttgtctataaaatcagaaacaatcgttgacatcattttatctggactgaatttatataaactatcataatccattggtttaacagatgagttaataaaatactctaacttatcccaatcatcatgacctattataaaaaagcgagattcactatagatttctgaaccaaatacatttatattattagtaattaattttttattgaaaaatagtgcctcaagtatacgaagagtccagccagattggttttctttggttatatcaacaattatattagcatttaatgttcttctaatattctcttcataagatatttgtttttcaatcaaatactttgaagtcgtagatgatgtcttatctttgacaacattaaaatctagcttacatcctagtgttgttaatctctcggctaactcattaattatttgaagacgccctttatcacgaccaaggaaaaaacatattggctggctgttatttttgtcagataaactataatttctaatttcatccattcctataggaaaaaattgttctattgccttgatcttttcattccctataaatctatgctcaaaatcatatataatatcgaaataattcgcgttatcaagaataaaatcttcgccaacagtatttcttagaagcaaaactttatgacagttaatattttttaatatttgtttattgatacctttattaacaacactgtcattaatgataattatgtcatcttttttaatatcattgaggtaatgcttgatgaataatcgccccagccatgcattatccatccctatttttgatatttttttattaatccagttatatttttttggtgttgttatattttttatcttgtacttttttttcaggtactgaatcatttttaattcataatctgcaacccaatttataaaataaatagtcataataaagttagttccagtacatactaataaatatttttataatcctttgcgttgtgttcgctctttaatacgctcggccttaacgcttgccatgttcaataaattctgttcaagagacaatattttgcgtaaaggcatcccaaaataaaccttcataaatcgccagatatctctttgcgtcaggccaatattcattgatgagaaatataaaccaatcaggtctttatcgcgccagcggcgcggtacttttgcacgtatctgtgcccgatgcagatcgataactgaaatttttaattcatcttcccggccagtaaatggcaaatgaagcaaaaagtggcaaatgtaacagtcgcggtgatttatccctgcagtatgcattttacgcaccatagttgctacacgtgcgatcagcatacgcttaacacgtatatcaggcgggttgactgcccaatcggcacaataatcttcaaggctaattgtgggagtgagatcttcggtaataataaatgatgcgcgagttaatggatttaaccctttttcgccaaacccaatgcccttcattgtatcaacgccaacatcactcaggcgatgaatagcgtgccactctctgtctgcgcccaaaacgggcatccgcaatgagagtagattttttataatctcttttaatgtcgtccccttgtgccatttaagaaaatagcttttcccggacagttcaaagcgtaatgtacgacgagtctccagttcacgaaagacctcgccgttcagttttttgacctctgcaaaagcatctttaccacgccaaagtgtggcaagcggctcttttaattcaaccatctaaaccacctgtaatgatatccgcggctttttctggcaagctatacaaatcctgagtatcggcataatggcgagcattctccgcccaggccattcgcaatggcgactgagttaacgctttacgtaaaacttcatttaattgttcctgagagaaaggttcagcgatgaccgttccacaattggcatccgcaatataatgcgcgtacccacataccgctgttgttaaaacaggtaacccagcagtgatcgcttctagaagaacgatacccgcggcttcctgataagcgggatgcagtaataaatcagcggctgccattaattctgacacatcattgcgaccggagaagaaatgcacattgctccgcacgccgagtttttctgccagcgcttcaaattttcgcggcttatcctgaccaacaacaaataaaagcgtattgtgacgtaatgattccggtaacgatgccaaagcttcaattgagcgatctacacctttacggccaaaatctgatccaacctgcagtaataagttttgttgctcttttatgccatttttctggcgataaatttcacggctgtttgggatttgctcactgtattttctgtccggataaataccgggaggaagaatttgaaaacgttcaggttcagtttgataatgcttctggaaatcggcgatttgcttatcggtcagcatcataagtttcgtcgatttaccctgctcgaaagtcgctcgctcaaatgcggcataatggcgatatcgtgatgttaaacgatataaaaaacctttttcttgcgcaactttctcggcgtaacaaacatcagcggcaaaataaacatccaggccaggcatcttattaaacccaacaacgcgatctgcgggatgctctttgagatgattttgtacccaggcataatattctgcattgcgtccatggttggtatgggacttaactggcacctgaataagctcaaatgctttcgggcaatcgccttcccacgactgtgtatatacccgaacatggtggccccgtgcggcaactgttgatgcaatgcgcataaagtcacgttgaagcccaccaaatggaaaatatttatataaacaaaacgccacgatcataattgtgcattcctgtcagctgaaggggcatcttctggcaacagcttttccgtagcggcgatcacatcctccgctgggataacagaaagatattttttgttgcggtcaagttcatgccgggtcggcattttctgataattccccgcccagaattgaataatattctcggtccagggacgccagaatacgtgatccgttgcaccaaatagactaatgactggcgttttcactgccgctgcaatatgtcccggcgcagaatccacaccaataaaaagcactgcatgatcaattaatgcacccagttcaggaaaacgtgttttacctgcaaggccagtaatgggttttgtttcgcaacctcgtgcaatctcatctacacaagcgagatcatctgccgagggcccacaggttagcacaacctgatagcctcgctgttgcagcgcatcgataaccttagaaaatttatcgttatcccaacacttaaatatctgacgcgctgtcggttggatgacaacataatgatcttttacgcccagggcatctaattcccggcgcatcttcttccagcaatcttcggcgtaactcattgttgtgtcggtgtagaaatcggtaatacctaatggctcaaggaccgataaattacgctcaacaatatgtgtaccgtgtattggcgctaagtgtgtgaagctttttttccaaataccatgctgccgatgaccataaagttgcgatattttcatccgtgcaggtaaacaacgtaccagcagcgccaccatccactgatccgtaagattaatgaccaggtcataattattcgcacgcagagtttttatcaacgaaagcacatttttaattttatcgaaagttcccgcacctttattgcttatcccatagagcgcattaatttccgggttttcagacaaaatagggatggtgtcctgataaagcagcatatcgatttttgcatcaggataattctgcttgagcgtactgatgacaggagtagttaataacatatccccatgatatcgcatctttatgaccaggatttttcgaaatggcttttccactagcgactcttttgtgtgattgtctggttaagttaagcagaaaaaagcacgctaccgccccaggctcaacagctacctgaatactgataacgcacttactttgacgtgctagtgtatcatttctttcgcagcaatccgacccgaatgatttttatacacaaaatatactttaatcataaaaatcaaatagataaaaaatagcatttcgataatgtcagtacggcctatgtagatttgaaaatggggccgagtttcaatgaatcgcataaaaatacaaaaaaaatgaagatgtagcggcagatcagaccaaactgaagctatttaagtcaaaaacgggaaaagtaatggtaaagccacagctaaatacatagaatccccagcacatccataagtcagctatttactatgctcgaattgctttacaccgcccttctctaccttattcagccgctgatctggatacggctctgggtgcgcggacgtaaggctccggcctatcgaaaacgctggggtgaacgttacggtttttaccgccatccgctaaaaccaggcggcattatgctgcactccgtctccgtcggtgaaactctggcggcaatcccgttggtgcgcgcgctgcgtcatcgttatcctgatttaccgattaccgtaacaaccatgacgccaaccggttcggagcgcgtacaatcggctttcgggaaggatgttcagcacgtttatctgccgtatgatctgcccgatgcactcaaccgtttcctgaataaagtcgaccctaaactggtgttgattatggaaaccgaactatggcctaacctgattgcggcgctacataaacgtaaaattccgctggtgatcgctaacgcgcgactctctgcccgctcggccgcaggttatgccaaactgggtaaattcgtccgtcgcttgctgcgtcgtattacgctgattgctgcgcaaaatgaagaagatggtgcacgttttgtggcgctgggcgcaaaaaataatcaggtgaccgttaccggtagcctgaaattcgatatttctgtaacgccgcagttggctgctaaagccgtgacgctgcgccgccagtgggcaccacaccgcccggtatggattgccaccagcactcacgaaggcgaagagagtgtggtgatcgccgcacatcaggcattgttacagcaattcccgaatttattgctcatcctggtaccccgtcatccggaacgcttcccggatgcgattaaccttgtccgccaggctggactaagctatatcacacgctcttcaggggaagtcccctccaccagcacgcaggttgtggttggcgatacgatgggcgagttgatgttactgtatggcattgccgatctcgcctttgttggcggttcactggttgaacgtggtgggcataatccgctggaagctgccgcacacgctattccggtattgatggggccgcatacttttaactttaaagacatttgcgcgcggctggagcaggcaagcgggctgattaccgttaccgatgccactacgcttgcaaaagaggtttcctctttactcaccgacgccgattaccgtagtttctatggccgtcatgccgttgaagtactgtatcaaaaccagggcgcgctacagcgtctgcttcaactgctggaaccttacctgccaccgaaaacgcattgaggttgttatgcaaaaacgggcgatttatccgggtactttcgatcccattaccaatggtcatatcgatatcgtgacgcgcgccacgcagatgttcgatcacgttattctggcgattgccgccagccccagtaaaaaaccgatgtttaccctggaagagcgtgtggcactggcacagcaggcaaccgcgcatctggggaacgtggaagtggtcgggtttagtgatttaatggcgaacttcgcccgtaatcaacacgctacggtgctgattcgtggcctgcgtgcggtggcagattttgaatatgaaatgcagctggcgcatatgaatcgccacttaatgccggaactggaaagtgtgtttctgatgccgtcgaaagagtggtcgtttatctcttcatcgttggtgaaagaggtggcgcgccatcagggcgatgtcacccatttcctgccggagaatgtccatcaggcgctgatggcgaagttagcgtagcgtttatgccggatggtatgccatccggcgcgcatgaattacttctggcactgccgacaataaaacgttgcccgctgcgcatgtttagtcgccacaatcggcgtaccgcacacccgacacggctcaccttttcgcccgtaaacctgcaattcctgagcgaaatagcccggtttaccatcactttgcagaaaatctttcagcgttgtaccaccctgctcaatcgaacgcagcaacaccgctttaatcacccgagctaacaattcacactctgccagcgacagtgatgacgccagccgatccggatggatccccgccgcaaacagtgattcgctggcatagatattccctacccctaccaccagcttgttatccatcagccacggtttaatcgccgtttttttcttcgcgcacttctgatgcagatactcaccattgaaatcgtcgctaagcggctccggtccaagatgggtcagcacattatgcccttccagctctttggtccacagccaggcaccaaagcggcgcggatcggtgtagcgcagcactttgccgttgctcatcaccaaatccacatggtcatgcttttcagggggaagttcttctggaaggatgcgcaggctgccagacatccctaaatgaatgataatccagccctcaggcagctccagcagcagatatttagcccgccgctgcacgctaagcactggttggtcgcttaaacggtagatctcttctgaaaccggccagcgcaagcgtccgttgcgcaccactgcatgaagaatggttgcaccaacgagatgcggttctatgccgcggcggctggtttcaacttcgggtaattcaggcatagcatctccaggaatgaacagatgcagtcaatatgggggcaagcagataacaaaaaaccccgccggagcgaggttttttgttacatcaaagcgagaattatttgattttcgcttctttgtagatcacgtgctggcgaacaactggatcgaattttttcagttccagtttttccggcttagtacgtttgttcttcgtagtggtatagaagtgaccagtaccagcagaagaaaccagcttgattttctcacgaatacctttagccatgatttatttcctctaagtacttagtacttttcgccacgggcacgcagttcagccagaactgtatcgatgccttttttatcgattacacgcatacctttagcagatacgcgcagggtgacaaaacgcttctcgctctcaacccagaaacggtgagagtgcaggttcggcaggaaacggcgtttagtcgcgttcagtgcgtgggaacggttgttaccggtcaccggacgcttgccagtaacttggcagactcgggacatgtctattctccaaaaatcaaattagctcgagcttcgtatggggtattggcgcctcgtcaggctttacagcccggtcatcgcagttctatgtgaactctcgattgccaggcccaaatgccaaacccgagattctcaaaggtggcgtagtatacgctgactcagcgatgtgctcaagtcccgaacagacaaagatcccgaaggatcgcgcatagcgggttaaatccagccgcgttcggcaaaagaaacatactctccacgcccaatcacgatatggtcgagcacgcgtaaatccatgaactgacaactctttattatccgttcagtaatgagtttatccgctttactgggttcagcacaacccgaagggtgattatgtgcaaggatcagcgccgaggcgtttatttttatcgcttcgcggataatttcccgaggatggacttcaacatggtttagcgtgccggaaaaaagacgcctatgcgttataacccggtgttgggagtcgagaaagatcaccataaagatctcccgctcctcacccgtgagctggctttgtaaaaattccctcgtcatctccgggctgagtaaagggctttcttcacgcatccgcacgttgtagtaacgccgcgccagttcagcaatcccctttaactgggcaaatttcgccacgccaattccatgaacgccactaaattgttcatattcagaggttaacaagccataaagagagccgaaattctccagcatctcttttgccagggttaatacatctttaccgcgcgttccggtacgcagaaatagcgccagcagctcgacatccgttaaggcgctaataccaaacttcagcattttttcgcgcggcatcaacagctgtgaattgtttttcaccttcacctcctttgtggtgctcgcatcctgtcatagccgtttcgttaaatcgacggccagttttcaatcctggaaagcgcctcgcaaagtgaatctcaggtgaaggcacgacaacaaaagtattgtgataaaatcgccaacttctggtgtcaccctacaggaaaaatcatcatgagcctggccggtaaaaaaatcgttctcggcgttagcggcggtattgctgcctataaaacccctgaactggtgcgtcgtttgcgcgatcgcggggccgacgtccgcgtagccatgaccgaagcggcaaaagcctttatcaccccacttagcttgcaggcggtttctggttatcccgtttccgacagtctgctggacccggcagccgaagccgctatgggccatattgagctgggtaaatgggctgatttagtgattctcgcccctgccacggcagatttgattgcccgtgttgctgccggaatggcgaatgacctggtatcgacgatttgtctggctacacctgcgcctgtagccgtgctccccgccatgaaccagcagatgtaccgtgccgctgccacgcagcataatttagaggtgcttgcttcccgtggtttgctcatctgggggccagacagtggcagtcaggcttgtggtgatatcggtcctgggcgaatgctcgatccgttaaccattgtggatatggcggtagcgcatttttcgcccgtcaacgacctgaaacatctgaacattatgattaccgccggcccgacgcgtgaaccgctcgatccggtgcgttatatctctaatcacagctccggcaagatgggttttgctatcgccgccgccgctgcccgtcgtggcgcgaacgtcacgctggtatcaggtccggtttcactaccgacgccaccgtttgttaaacgtgttgatgtgatgaccgcgctggaaatggaagccgccgtgaatgcttctgtacagcagcaaaatatttttatcggctgcgccgccgtggcggattatcgcgcagctaccgtggccccagagaaaatcaaaaagcaggccacgcagggtgatgaattaacaataaaaatggttaaaaaccccgatatcgtcgcaggcgttgccgcactaaaagaccatcgaccctacgtcgttggatttgccgccgaaacaaataatgtggaagaatacgcccggcaaaaacgtatccgtaaaaaccttgatctgatctgcgcgaacgatgtttcccagccaactcaaggatttaacagcgacaacaacgcattacaccttttctggcaggacggagataaagtcttaccgcttgagcgcaaagagctccttggccaattattactcgacgagatcgtgacccgttatgatgaaaaaaatcgacgttaagattctggacccgcgcgttgggaaggaatttccgctcccgacttatgccacctctggctctgccggacttgacctgcgtgcctgtctcaacgacgccgtagaactggctccgggtgacactacgctggttccgaccgggctggcgattcatattgccgatccttcactggcggcaatgatgctgccgcgctccggattgggacataagcacggtatcgtgcttggtaacctggtaggattgatcgattctgactatcagggccagttgatgatttccgtgtggaaccgtggtcaggacagcttcaccattcaacctggcgaacgcatcgcccagatgatttttgttccggtagtacaggctgaatttaatctggtggaagatttcgacgccaccgaccgcggtgaaggcggctttggtcactctggtcgtcagtaacacatacgcatccgaataacgtcataacatagccgcaaacatttcgtttgcggtcatagcgtgggtgccgcctggcaagtgcttattttcaggggtattttgtaacatggcagaaaaacaaactgcgaaaaggaaccgtcgcgaggaaatacttcagtctctggcgctgatgctggaatccagcgatggaagccaacgtatcacgacggcaaaactggccgcctctgtcggcgtttccgaagcggcactgtatcgccacttccccagtaagacccgcatgttcgatagcctgattgagtttatcgaagatagcctgattactcgcatcaacctgattctgaaagatgagaaagacaccacagcgcgcctgcgtctgattgtgttgctgcttctcggttttggtgagcgtaatcctggcctgacccgcatcctcactggtcatgcgctaatgtttgaacaggatcgcctgcaagggcgcatcaaccagctgttcgagcgtattgaagcgcagctgcgccaggtattgcgtgaaaagagaatgcgtgagggtgaaggttacaccaccgatgaaaccctgctggcaagccagatcctggccttctgtgaaggtatgctgtcacgttttgtccgcagcgaatttaaataccgcccgacggatgattttgacgcccgctggccgctaattgcggcacagttgcagtaatatgacgccggatgacttttcatccggcgagtttctttaaacgccaaactcttcgcgataggccttaaccgccgccagatgttccgccatttccggcttctcttccaggtaagcaatcaggtctttcagggtgatgatagagatcactttgcagttgtaatcacgctcaacttcctgaatcgccgaaatctcgccgcgcccgcgttcctgacgatcgagcgaaatcaacacgccagcaagcgtcgcgccattggcctgaataatctccatcgactcgcgaatcgccgttccggcggtgatcacatcatctaccagcattacgcgtccttgtaacgcgctaccaaccagattgccgccttcaccgtggtcttttgcttctttgcggttaaagcagtacggcaggtccaggtcgtgatgctccgccagtgccacagcggttgtggtggcaatcgggatccctttgtaagcagggccaaacagcagatcgaactcaatgccggaatccaccaacgcttcagcgtaaaaacggcctaacagtgccagatcgcgcccggtattaaacagcccggcgttgaagaaataggggcttttgcgcccggatttcagcgtaaactcgccaaactttaacacctgcttgctaagcgcaaattcaataaactggcgctgatatggtttcatgccttcgctcctcatcttacttttctacagacaaaaaaaaggcgactcatcagtcgccttaaaaatcagtttgccagcgccgccttctgcgtcgctacaatggattcgattcccctcgggccagagccaacaagatgagtagctcttcatgggtgaacggctcgccttctgccgtcccctgcacttcaatgatgcgcccgtcttcggtcatcactacgttcatgtcggtctctgcggcagagtcttcaacgtattccagatcgcaaaccgcttcgccgttcacaattccgacagaaactgcggctaccatccctttcatcggattggttttcagcttgccgttttccaccagcttctgtagcgcatctaccagcgccacgcaggcacccgtaatcgacgcggtacgcgtgccaccatcagcctgaagcacgtcgcagtccagcgtaatggtgaactcacccagcgctttcaaatctactgccgcgcgaagagcacgggcgatcagacgctggatttccattgtgcgtccaccctgcttacctttcgccgcttcacgagcgttacgggtgtgggtagaacgtggcagcatgccgtactctgcggtgatccagccctggccctgacctttcaggaagcgcggcacgccttcttcaatagaggcggtacacaacactttggtatcgccaaattcgaccagcaccgagccttctgcatgttttgtatagttacgagtcagggtaacgggacgcacctgattattgctacggcctgctggacgcatattgaaatctccggcttgaaacaaatgtggctgcgcattatacggacttccggcggttattcctatcctgacaaggcatcgatggctataatccttccacctctccttttataaacaggaacgtctatgatccgcagtatgaccgcctacgcccggcgtgaaatcaagggtgaatgggggagcgcaacctgggaaatgcgctcggtaaaccagcgttatctggaaacttactttcgtctgccggagcagttccgtagccttgaacctgtcgttcgcgagcgtattcgttctcgcctgacgcgcggtaaagtggaatgtaccctgcgctatgagccagatgttagcgcgcaaggtgagctgatcctcaacgaaaaactggctaaacagctggtaactgccgcgaactgggtaaaaatgcagagtgacgaaggggaaatcaacccggttgatattctacgctggccgggcgtgatggcagcccaggagcaggatcttgacgccattgccgctgaaattctcgcggcgctggatggtacgctggacgactttattgtcgcgcgcgaaaccgaaggtcaggcactgaaagcattgatcgagcagcgtctggaaggcgtcaccgccgaagtggtcaaagtccgctcccatatgccggaaatcctgcaatggcagcgtgagcgtctggtcgcgaagctggaagatgctcaggtgcaactggaaaacaaccgtctggagcaggaactggttctgctggcacaacgaattgacgttgccgaagaactggatcgcctcgaagcgcatgtcaaagagacctacaacattctgaagaaaaaagaagcggttggtcgtcgtctggattttatgatgcaggagttcaaccgcgagtcgaacactcttgcgtcgaagtctatcaatgccgaagtgacaaactccgccatcgagctgaaagtgttgattgagcagatgcgcgagcagattcagaacatcgaataactcgtaacgccaattcttacttttccgccttcacaaatgccgccactcaaacagagcggcatttttcttccccgcaacattcaattctgttttgcgtgcctgctccagattttgcgatgtttttttgcccagcacactgagaacgtgagatactcacaactgtatataaatacagttacagatttactttctttgcaattgatatcacatggagtgggcaatgaacgaacatcatcaaccttttgaagagataaaactgattaatgcaaacggagcagaacaatggtcagcaagacaacttgggaaactactgggttattcagagtatcgtcactttatacctgtattaacgcgcgccaaagaagcctgtgagaacagtggtcacacaattgatgaccatttcgaggagatcctcgatatggtcaaaattggctcaaatgccaaaagagcattaaaagacatcgtactctcccgctatgcctgttacctggtagtacaaaacggcgaccctgcgaaaccggtcattgcggcagggcagacttattttgctatccagacccgacggcaggagcttgctgacgatgaagcatttaagcaacttcgtgaagacgaaaagcgtctgtttctgagaaatgagttgaaagaacataacaaacaattggttgaggcagcacagcaagctggggtagcgacagctactgatttcgccatatttcagaatcatggttaccaggggctgtatggtggattagatcagaaagctattcatcagcggaaggggctgaaaaagaatcagaagatcctggatcatatgggttcaacagaactggcggctaatctctttcgagctacccaaacagaagaaaaactcaagcgggatggcgtgaattcaaaacagcaagcaaacaccacacactttgacgtgggtcgcaaggtgaggcaaaccattcaggaacttggcggaaccatgcctgaggagttgccgaccccgcaggtcagcatcaagcagttggaaaacagtgtaaaaattacagagaagaaatagcagaaactaaaaactctttttgttgattgagacacccgatgcgtaagccaaggtccaggtgcagtgaacacaatggctaaatattgcacctttcttttccccctcagttttaacctattttttcttatgcattttctcagacaagaagtcagaagaatgcatctctgctacagaaaatagcgatttcacataactacaagttatcaatttcccctccccttaaaaaatctcaatcgtgacaatgcgcacaaatcgctaccctgccagacagatttttagggagagaaccatgctgttacacattttgtatttggttggcattactgccgaagccatgacgggggcgctggcggccggacgacggcgcatggatacatttggcgtaattattattgcgaccgccaccgcaattggcggagggtcagtgcgcgatattctgctgggccactatccgctcggctgggtcaaacacccggaatatgtgattatcgtcgctaccgccgcagtactcaccactatcgttgctcctgtaatgccttacctgcgcaaagtgtttctggtgctcgatgcgctcggactggtggtcttttctatcatcggggcacaggttgcactggatatggggcacggcccaattattgccgttgtcgcggcggtaaccaccggcgtgtttggcggcgttttgcgcgatatgttctgtaaacgtatcccactggtattccagaaagagttgtatgccggtgtctcatttgcctccgccgtgctgtacatcgcgctgcaacactatgtttctaaccatgatgtggtaattatctccaccctggtattcggcttttttgcccgcttactggcgctacgccttaagctgggattaccggtcttttactacagccacgaaggacactaaggttcaaaacctgtgatctgctgggcagccagccaactgcccagcttcttgatttgcgcattttccttccattcaataacctgtctggcgcgtcccgatccagtccccggcagctgctgccagaactgctccgtgctaaataaaagttgcgaccaggaccgttcatcactggcattaagcgccgcccgggttagcggtattcccattgccatcacccagcgagtaaaaggctgcttacgagccagattaaactgatgccatagctgcgcacttttacttttcgcgatccccggcgtgttctgtaattgctctggcgttaataaaagccaggaaaagatatgttcaaagcgatgagtctgatgcagcgcgcgccaaccggcctcaccaatgccatccagcccaagaacctgttttgcccccagccagactaagcgtgaaatgaactgttcctgacaaacatcagaagcaaagtagcaggtcaacgagttaaagcggttttctggcggtgtcggttttgtacgttctgcaccgcgccacaccacatcatcaatgcgaggaataccctgaccggcaaggctgacgagaatctgatcaccaggcgcaatatcccactcctgccagcgcctgacggaaccaatattcacccgctggacttttttatcatccagcatgacaggtgcgagtgacgcaaccaccgatattttaccgctcttacccaccgcaaactgaattgccttcacttcggcaacctgagctacaggttgatatttccaggccaccagccactctgcctggcccggtagccaatggcgggattctggctctttcgccgctcgtacaactacgccatcggtgacgaagggtaattccgctttccaccactcattgcgtacgcgcgcaacttcatcagcatttttcaccgcacgggtatacgtctgcgttagagtaaaacctgcggtagccagctcttttaaacgatcagacattaactgcggtccatccggccatgcccagacaaaaacgcccagagaattcagcgtgtcgctatcgtcctggcgcatcatcaagccagcaacttttgcgcgggcatttattccccccatttgttgttggatatgcccctcgcgctggagaaatatttccccctgaagcgtactgttggctaaaggcccgctaacggtttgcggcacagcggaaattaagctaactttctgcgtccagtcctcgcctttcaggccattaccgcgactgattgctttgttcagtttcccgtcccgataaaccagggttaccgcaacgccatcaacttttggctgcacccaaagatcgctacgttctcgcatccacagacttaatgcgtttttatccaccattttgcgtacacccgtatgggcaaccggatgcataaccgcaccatttaaaggcggcatcatcacgtcgcggggctcgctcccaaagcagcgttgccactgcgtaagacgggcgcttaactgatcgtaaacaccgtcttccacctcactttttccttccttccagtagtcatcgtcccactgttttatttgctgttgcaggcgggaaatttcttcctgtgctctggctggcgaccaggccggacagaccgcccacacagatgattgccagcacaagatacctattaatatcgccatccatactttcatcatcacctccgctgtagatagtcaggcagatatacaacgtgatgaaagcaaagccgagtggcaaaaacggagtctgcgaggacgcttcctgaaaatcgtctttattgcagtgaatgacaggcaaatgcggaagcagctacgcaaaacgcaacaactttgcgcaaaaagtgtgagcaagggctacgtcacatggccgcgccgtgtataataagctcgtatgtaggctttatttcgctaatcacatacgaaagatactcatggctcaaggcacgctttatattgtttctgcccccagtggcgcgggtaaatccagcctgattcaggctttattaaaaacccaaccgttgtatgacacccaggtttctgtttcacacaccacacgccaaccgcgtcctggtgaagtccacggtgaacattatttctttgttaatcatgatgaatttaaagaaatgattagcagagatgcgttcctcgaacacgcagaagtttttggtaattactatggcacttcgcgtgaggccattgagcaagtactggcgaccggtgtcgatgtttttctcgatatcgactggcagggcgcgcagcaaattcgccagaagatgccgcacgcgcggagtatctttattttaccgccgtccaaaattgaactggaccgccgtctacgcggtcgcggtcaggacagcgaagaggtcattgcaaagcgtatggcgcaagctgttgcagaaatgagccattacgccgaatatgattatctgattgtgaatgatgacttcgataccgcgttgaccgatttgaagaccattattcgcgccgaacgtctgcgcatgagccgccaaaagcagcgtcatgacgctttaatcagcaaattgttggcagactgaacctgatttcagtatcatgcccagtcatttcttcacctgtggagctttttaagtatggcacgcgtaactgttcaggacgctgtagagaaaattggtaaccgttttgacctggtactggtcgccgcgcgtcgcgctcgtcagatgcaggtaggcggaaaggatccgctggtaccggaagaaaacgataaaaccactgtaatcgcgctgcgcgaaatcgaagaaggtctgatcaacaaccagatcctcgacgttcgcgaacgccaggaacagcaagagcaggaagccgctgaattacaagccgttaccgctattgctgaaggtcgtcgttaatcacaaagcgggtcgcccttgtatctgtttgaaagcctgaatcaactgattcaaacctacctgccggaagaccaaatcaagcgtctgcggcaggcgtatctcgttgcacgtgatgctcacgaggggcaaacacgttcaagcggtgaaccctatatcacgcacccggtagcggttgcctgcattctggccgagatgaaactcgactatgaaacgctgatggcggcgctgctgcatgacgtgattgaagatactcccgccacctaccaggatatggaacagctttttggtaaaagcgtcgccgagctggtagagggggtgtcgaaacttgataaactcaagttccgcgataagaaagaggcgcaggccgaaaactttcgcaagatgattatggcgatggtgcaggatatccgcgtcatcctcatcaaacttgccgaccgtacccacaacatgcgcacgctgggctcacttcgcccggacaaacgtcgccgcatcgcccgtgaaactctcgaaatttatagcccgctggcgcaccgtttaggtatccaccacattaaaaccgaactcgaagagctgggttttgaggcgctgtatcccaaccgttatcgcgtaatcaaagaagtggtgaaagccgcgcgcggcaaccgtaaagagatgatccagaagattctttctgaaatcgaagggcgtttgcaggaagcgggaataccgtgccgcgtcagtggtcgcgagaagcatctttattcgatttactgcaaaatggtgctcaaagagcagcgttttcactcgatcatggacatctacgctttccgcgtgatcgtcaatgattctgacacctgttatcgcgtgctgggccagatgcacagcctgtacaagccgcgtccgggccgcgtgaaagactatatcgccattccaaaagcgaacggctatcagtctttgcacacctcgatgatcggcccgcacggtgtgccggttgaggtccagatccgtaccgaagatatggaccagatggcggagatgggtgttgccgcgcactgggcttataaagagcacggcgaaaccagtactaccgcacaaatccgcgcccagcgctggatgcaaagcctgctggagctgcaacagagcgccggtagttcgtttgaatttatcgagagcgttaaatccgatctcttcccggatgagatttacgttttcacaccggaagggcgcattgtcgagctgcctgccggtgcaacgcccgtcgacttcgcttatgcagtgcataccgatatcggtcatgcctgcgtgggcgcacgcgttgaccgccagccttacccgctgtcgcagccgcttaccagcggtcaaaccgttgaaatcattaccgctccgggcgctcgcccgaatgccgcttggctgaactttgtcgttagctcgaaagcgcgcgccaaaattcgtcagttgctgaaaaacctcaagcgtgatgattctgtaagcctgggccgtcgtctgctcaaccatgctttgggtggtagccgtaagctgaatgaaatcccgcaggaaaatattcagcgcgagctggatcgcatgaagctggcaacgcttgacgatctgctggcagaaatcggacttggtaacgcaatgagcgtggtggtcgcgaaaaatctgcaacatggggacgcctccattccaccggcaacccaaagccacggacatctgcccattaaaggtgccgatggcgtgctgatcacctttgcgaaatgctgccgccctattcctggcgacccgattatcgcccacgtcagccccggtaaaggtctggtgatccaccatgaatcctgccgtaatatccgtggctaccagaaagagccagagaagtttatggctgtggaatgggataaagagacggcgcaggagttcatcaccgaaatcaaggtggagatgttcaatcatcagggtgcgctggcaaacctgacggcggcaattaacaccacgacttcgaatattcaaagtttgaatacggaagagaaagatggtcgcgtctacagcgcctttattcgtctgaccgctcgtgaccgtgtgcatctggcgaatatcatgcgcaaaatccgcgtgatgccagacgtgattaaagtcacccgaaaccgaaattaatgttttatgaacccaacacgttatgcacgcatctgcgaaatgctcgccaggcggcagcctgatctgaccgtctgcatggagcaggtccacaaacctcataacgtttctgcgattattcgtaccgcagatgccgttggcgtacatgaagttcacgccgtctggcctggtagccgcatgcgcaccatggcttcggcagcggcgggtagtaacagctgggtacaggtgaaaacacaccgcaccattggcgatgccgtcgctcatctcaaaggccagggcatgcagattctggcaacccatctttctgataacgctgtcgatttccgcgaaattgattacactcgcccgacctgcattttgatgggacaggagaaaacgggcatcacgcaggaagcattggccctggcggatcaggacatcatcattccgatgatcggcatggtgcagtcgctgaatgtttccgttgcctcagccctcattctttacgaagcccagcgtcagcggcaaaatgcaggcatgtacctgcgtgaaaacagcatgttgccggaagcagagcaacaacgcctgttgtttgaaggcggctatccggtgctggcgaaagtcgcaaaacgcaaaggcctgccttatccccacgtcaatcagcaaggcgagatcgaagctgatgccgactggtgggctactatgcaggctgcagggtaagtgccatgaaaggtcgcctgttagatgctgtcccactcagttccctaacgggcgttggcgcagcacttagtaacaaactggcgaaaatcaacctgcataccgtgcaggatctactcttacaccttcccctgcgctacgaagatcgcacccatctctaccccatcggagaactactgccgggcgtttatgccacggtggaaggcgaagtgctgaactgcaatatctccttcggcggtcggcggatgatgacctgccagatcagcgacggttccggcatcctcaccatgcgctttttcaatttcagcgcggcaatgaaaaatagcctggcggcgggccgccgtgtactggcttatggcgaagcaaagcgcggtaaatatggtgcggagatgatccacccggaataccgcgtgcagggcgatctcagcacgccagaattacaggaaacgctcacgccggtttatccaacaacggaaggcgtaaagcaggccacgctgcgtaaattaaccgaccaggcgctggatctgctcgacacctgcgccattgaagaactcctgccgccggaactgtcacaaggaatgatgacgctaccggaagcgttgcgcactttgcaccgcccgccaccgacgctacagcttagcgatctggaaaccgggcagcatccggcgcaacgtcgtctgattctggaagaactgctggcgcacaacctcagcatgttagccttacgtgccggagcacagcgttttcatgcccagccgctgagcgccaatgacacgctgaaaaataaactcctcgccgccttaccgttcaagccaacgggcgcacaggcacgcgtagtggcggagatcgagcgcgatatggcgctggatgtgccgatgatgcgtctggtgcagggcgatgtaggttccggtaaaacgctggtcgccgccctcgccgcgttgcgtgcgattgcccacggcaaacaggtagcattgatggcaccaaccgaattactcgccgagcagcacgccaataacttccgcaactggtttgcaccgctcggtatcgaagtgggctggctcgccggtaagcagaaaggtaaagcacggctggcacagcaggaagccatcgccagcggtcaggtgcagatgattgtcggtacacacgccatcttccaggaacaggtgcagtttaacggcctggcgctggtgattatcgacgaacagcatcgttttggcgtgcatcagcgtctggcattgtgggagaaaggccagcagcagggcttccatccgcatcagttgatcatgaccgccacgccgatcccccgcacgctggcaatgactgcgtatgccgatctcgatacctcggtgatagatgagctgccgccaggccgcacgccagtgactacggtcgctattcctgatacccgccgtaccgacatcattgaccgcgtgcaccacgcctgcataactgaaggtcgtcaggcatactgggtttgtacgttgattgaagagtcggaattgctggaagcgcaggcggcggaagctacctgggaagagttgaaactggcgctaccagagttgaacgttggcctggtacacgggcggatgaaacctgccgagaaacaggcggtgatggcgtcgtttaaacaaggtgagctacacctgctggttgccacaaccgttattgaagtcggcgttgatgtgcctaacgccagtctgatgattatcgaaaacccggagcgtctgggtctggcgcagttacaccagctgcgcgggcgcgtaggtcgtggcgcggtggcttctcactgcgtgctgctctacaaaacgccgctttctaaaacggcgcaaattcgcctgcaagtgctgcgcgacagtaacgacggttttgtgattgcgcaaaaagatctggagattcgcggccctggcgaattgttaggcacgcgtcagacgggtaatgctgaatttaaagtggcggatttactgcgcgatcaggcgatgatcccggaagttcagcgcctggcacgccatattcacgaacgttacccacaacaggcaaaagccctgatagaacgctggatgccggagacggaacgttactcgaatgcgtaaaaggcggcagtgagaagaccgccatttcaggttaccctaccttcctgccggatgcgattcatcaccctacaaattcaataaattatgaatcaatacgcaggcttgataagcgaagcgtatcaggcatttgtctttgttgcggcggcacttctaccgccgcttcatcggttaaccggcaaaaatcggcaacatcaaatacaacttaattaccagcgcattgacgatatcgataaagaacgcaccgaccatcggcaccaccaaaaacgccatgtgcgacgggccaaagcgttcagtgatcgcctgcatgttggcgattgccgttggcgttgcaccgaggccaaaaccacagtgacccgcagccagcactgccgcatcgtagtttttgcccatcatgcgccaggtaacgaagatggcatacaacgccatgaagatggtctgtaccaccagaatcgccagcatcggcagcgccagcgaagccagctcccacagtttcagccccatcaacgccatcgccaggaacaacgacaagcttacgttacccagcacggataccgcacgctcaaagacgcggtaaaagcccattattgacagaccgttgctcagaatcacgccaacaaacagtacacagacgaaggtcggcagttcaaaagcagtgccagccaaaagttgcgcaacaattttccccaccgtcaggcagatagcaatcagcgcgatagtttcaatcagcaccaacgaggtgatcatgcgtcccacatccggcttttcaaacgccgtcgggacttcctggtcatccggaataccgttcggcgtggtggagtgtttcaccagatagcgcgccaccggaccgccaatcaagccgcccagcaccagaccgaacgttgcacaggccatcgccacttccgtcgcattggtgaagccataacgttcaatgaacaatttactccacgcagcgcccgtaccgtgaccgccggaaagagtaatagaaccggccaacagccccatcagcggatcaagccctaacaagctagccataccaatgccaatggcattttgcatcaccaacagaccaacaaccacaatcaagaagatgccaaccacacgcccaccggcacgcaaactggcaatgttggcgttcaggccaatggtggcgaagaaagccagcattaacggatcgcgcagggacatatcaaagttgacttcccagcccatgctttttttcagtactagtagcgccagcgccaccaacaaaccacccgcaacaggttccggtatggtgtatttcttcaaaaaggagacggaatggaccaacttacgcccgagcagcaacgtcagcgttgcggcaacaagcgttgctaaagtatcgagatgaaacatagttactcctttgtatccgcatcactctttcatactcgtcatacttcatcgcgcagtggcaacttcatgaactatgacgggtatcgagttatgctttcctgggtcaaattctcagctgttaatgaacaaatggcatggattttaagcagaaaaataccaaaagttatataaaaaagtgcatttatctcatttaaatatttagatgaggatgtggcaaacgtttgcttttctctttcggtcagctaaaatgcccgctttgctaccacgggattgttttcgatgtctgtttccaccctcgagtcagaaaatgcgcaaccggttgcgcagactcaaaacagcgaactgatttaccgtcttgaagatcgtccgccgcttcctcaaaccctgtttgccgcctgtcagcatctgctggcgatgttcgttgcggtgatcacgccagcgctattaatctgccaggcgctgggtttaccggcacaagacacgcaacacattattagtatgtcgctgtttgcctccggtgtggcatcgattattcaaattaaggcctggggtccggttggctccgggctgttgtctattcagggcaccagcttcaactttgttgccccgctgattatgggcggtaccgcgctgaaaaccggtggtgctgatgttcctaccatgatggcggctttgttcggcacgttgatgctggcaagttgcaccgagatggtgatctcccgcgttctgcatctggcgcgccgcattattacgccgctggtttctggcgttgtggtgatgattatcggcctgtcgctaattcaggttgggttaacgtccattggcggcggttacgcagccatgagcgataacaccttcggcgcaccgaaaaatctgctgctggcaggcgtggtcttagccttaattatcctgcttaaccgtcaacgtaacccttacttacgcgtggcctcactggtaattgcgatggcggccggatatgcgctggcgtggtttatgggcatgttgccagaaagcaacgaacctatgacgcaagaactgattatggtgccaacgccgctctattacggtcttggcattgaatggagtctgctgctgccgctgatgctggtctttatgatcacttcgctggaaaccattggcgatatcacggcgacctctgacgtttccgaacagccagtgtccggtccgctgtacatgaaacgcctgaaaggcggcgtgctggcaaacggcctgaactcgtttgtttcggcggtgtttaacaccttcccgaactcctgcttcgggcaaaacaacggagtgatccagttgactggtgttgccagccgctatgtcggttttgtcgtcgcgctgatgttgatcgtgctgggtctgttcccggcagtgagcggttttgtacaacacattccagaaccggttctgggcggcgcaacgcttgtaatgtttggcaccatcgccgcctccggtgtgcgtatcgtttctcgtgagccgctgaaccgtcgggcgattctgattatcgcgctgtcgctggcggttggtctgggcgtgtctcagcagccgctgattttgcagtttgcccctgaatggctgaaaaacctgctctcctccgggatcgccgcgggcggtattactgccatcgtgctgaatctgattttcccaccagaaaaacagtaattcactggcggcggtaagataattaccgccgcagtctcacctctttaaccattcccgccttgaggattgcgcgtaaatcgtgcataactcccttatgtgcatttcacgggatggaagaccatgaaatttattgggaagctgcttctctacattctcatcgctctgttagtggcgatcgctggcctctattttcttctgcaaacccgctggggagcagaacatatcagcgcatgggtttccgagaatagcgactatcatctggccttcggggcgatggatcaccgtttttccgcgccatctcatatcgtgctggagaacgtcacgtttggtcgtgatggccagcccgcgaccctggtggccaaaagtgtcgacattgcgctaagcagtcggcaactgaccgaaccacgccatgtcgataccatcctgctggaaaacgggacgctgaatctcaccgaccagaccgcgccgctaccgttcaaagccgatcgtctgcaactgcgtgatatggcgtttaatagcccgaatagcgaatggaaactgagcgcgcagcgggtaaatggcggcgtagttccgtggtcaccaaaagccggtaaagtgctgggtacgaaggcgcagattcagtttagtgccggatcgctttcgctcaatgatgttcctgccaccaatgtactgattgaaggcagtattgataacgatcgcgttacgctgactaacctgggtgccgacatcgcccgcgggacattaaccggaaacgcgcagcgtaacgccgacggcagctggcaagtggaaaacctgcgcatggcggatatacgtctacaaagcgaaaaatcgctaaccgacttctttgcgccattacgctctgtcccgtcgttgcagattggtcgcctggaagtgatcgatgctcgtttgcaaggtccggactgggcggtgaccgacctcgatctcagcttgcgcaacatgaccttcagtaaagatgactggcagacacaggaaggcaaactgtcgatgaacgctagcgagttcatttatggttcgctgcatttatttgacccgattataaacacggaattttccccgcagggcgtagcgctgcgccagttcaccagccgctgggaagggggtatggtcagaacgtcagggaactggctgcgtgacgggaaaacgttgatccttgatgatgcggcaattgccgggctggaatataccttgccgaaaaactggcaacagttgtggatggaaacgacacccggttggttaaacagcctgcaactgaagagatttagcgccagccgcaatctgatcattgatatcgaccctgacttcccgtggcagctcaccgcgctcgatggttacggtgccaacctgacgctggttaccgatcataaatggggcgtctggagtggctcggcgaatctgaatgccgccgccgcgacattcaatcgtgttgatgttcgtcgcccgtcgctggcgctgaccgccaacagcagcacggtgaatatcagcgaactgagtgcatttactgaaaaaggcattctggaagccaccgccagtgtttcacaaacgccacaacgtcagacacatatcagcctgaatggacgcggtgtgccggtgaatattttgcaacagtggggatggcctgaattaccgttgactggcgacggcaatattcagcttaccgccagtggcgatattcaggccaatgtcccgttgaaacctacggttagcgggcaattgcatgccgtgaacgccgcaaagcagcaagtgactcaaaccatgaatgctggcatcgtttccagcggtgaagttacatcgacggagccggtgcggtaaacatcaatctcgccgggtacgactcagacgtacccggcattccatcaatagattacaacgtaattgtcagcgcattcccttgaggcttcaccaccagcccctgctcactttcagcctgcgaaccgtcttgcagaccatttactttcacaacattgcgcaggcacagtgtccagttcttcgcctcgcccgcaccagtcacagtaatcgtgttgccagtacgtgctgcttttaaagtaaagatcaccgatccgtcagcagcgggcacttcacagacggcttcatgcccgtcttgcagattgaagaggtggaatgccgtgccttcgtgccacacgtaatcgggacgttgatcgttgttgcccagcgccagtagagtgttatcacgcacataaacgggcagactcaggaagccgtgctgctgtttatgccagcgactaccgtcgagttcatcgttgtgccacaggtgtgtccagcgaccttccggcaggtagaactgcacatcgcccgcttcagtgaacaccggcgcaaccatcacgttgtcgcctaacatgtattgacggtcaaggtaatcacaagccggatcgtccgggaactccatcatcatggcccgcatcatcggcgtaccccgcgcgttcgcacgcgcagcttcacgatacagatacggcatcatgcggcatttcagttgcgtgaagaagcgcaccacatcacaggactcatcatcgtaggcccacggcacacgataagatttgctaccgtgtaaacggctatggctggagagcaaaccaaacgcgcaccagcgtttgtaaacgtgcgccggagcggtattttcaaagccgccgatatcgtggctccagaagccaaaacctgaaaggccaatagacaaaccaccgcgcaggctttccgccattgattcgtagttagcgtaacaatcgccaccccagtgtaccgggaatttctgcgcaccgacggaggccgagcgggcaaacaagacagcttcttcctcaccaacggtgtccttgagcacgttccacaccagttcgttgtagatgtacgcataatggttatgcattttctgcggatcggaaccgtcaaaccactgaacatcagttgggatacgttcgccaaagtcggtcttaaagcaatcaacgcccatcgcgaccagacctttcagtttgtcggcgtaccatttgcaggcatccggattggtaaagtcataaatcgccagacctggctgccatttatcccactgccatagcgaaccgtccgggcgtttgagtaaatagcctttctcttgtaactctttaaagacgggggatttttgaccgatataggggttaatccagacgcagattttcagtcctttcgctttcaggcggcggatcatcccttccgggtcagggaaagtcagcgggtcccactcaaaatcgcaccactggaaggctttcatccagaaacagtcaaagtggaaaacatgcagcggcagattgcgttccgccataccatcgataaagctgtttaccgtcgcttcgtcgtagttggtggtaaatgaagtggttagccacaggccgaaggaccacgcgggcggcagcgccggacgaccagtaaagcgggtataacgatcaagtaccgctttcggcgtcgggccgtcgataacaaagtattcgagatattcactctcaacgctgaactgcactttggagactttctccgatcccacttcaaaagagacacactggggatgattgaccagtaccccataaccacggttagtcatgtagaacgggatatttttatacgcctgttcagtacttgtgccgccgtcccggttccaggtctctaccgtctggccattgcgcaccagggcagtaaagcgctctcccagaccgtaaactgtttcgccaacgccaagatcaagccgctcaaacatataattgcgttgattattcgtgtcctgcacgtagccattatttttcacctgactaccggtaatacgttcgccgttgcgcagaaaatccagtgaccagaactcacctttgctgacacgcgcgcttaagttgccacttttaaactcagcataacgttctgtgttttcgattgtgaccttcacgtcctgcaaaatattgagcggataatgaggaccgttattcagcgccccctgaaaatgctcaatccgcacaccgacaataccttcctgtggggagaaaaagcgcaacgtaaataaaggcgtatcaagctgccaggtacgttcacgcacatcacggggggcagcatagaccaccatttcattatcctgctgttcaacctcgaacacctgaagcgggtgaatcaaattgaggccaggttgaatcaaccagtttccatcgctaattttcattgccgttccttagttctgcacttcttgagaggtgaattgttgctggcaacggcgtttaccctgagccagctgttccataacggttttcagattgtgcgtcgtgagtgagtagtagcgtttagcgataatcgcgctcagcaaataacagatcgccggaacaatcgtgaatagcgcaataatgatgctaatcgtggcgctgttctgcgctttttctgccgcatcatatccgccataagccagcatccagccgataagagcgccgccgaaggccaaccccagtttgagcacaaacagcgtgccagcaaaactgatcccggtcaggcgtttaccattgcaccactcgccgtagtcgacggtatcggacatcattacccactggataggtgtcaccagttgatgcaacacaccaatcacgaagatgaagacaaacatagtgatgctggcctgcatgggaacaaagaacatcgcgaggctaatcactgccagcagggcgttcgtccaccagaagatagtgactttacatttccagtcggtcagaggttttgccagtgcggaaccaatcaggttacccacgcaataagtggtgagaaaagcgacaaacacttccggcgtgcccaaaatccatgtgacgtaatacatcatcgccccaccgcgtacgcacaccgccaggatattgaaaatggttagtaaaccgacaatccgccactggtcgttttgccagatatcacgtaaatcttcccgcatagacgttgttgtaggtggtgcttcaacgcgttctttagtggtgaagaaacaaaatgccagcatcatgaatgccaccacggaaaggaccgcgataccgccctggaaaccgagtggtttattatcaccgccaattaaattaaccagtggcatcatcagaacagtagaaagcatgcctcccgcggtcgccagcacaaaacgccaggattgcagcgagatacgctgagtcgggtcattggtgattacaccacccaatgcgcagtaagggatattgacgacggtataaagtaaggtaagtagggtgtaagtaattgctgcatagatcattttgccgttcatactgagatctggcgtgctataggccagtacacagacgatcccgaatggcagtgcgccaaacagtacccacggacgaaatttaccccagcgagagcgcgttcgatcggccaacaaccccatgcaaggatcggaaatcgcatccagtgcacgagcgaccaaaaacatggttccgacaaaaccggcaggaatgccaaaaatatcggtataaaagaacatcatatataacattacgttatcgaaaataatgtggctggcggcgtctcccatgccataaccaattttctctttaacggacaacacttcactcttcatctgcttttccttgatgctataggggtgctgagaccgataacgcattttgtaaaccatccctgtgagagcgaatattccgatatctggttattaatttatgattcttgttttatgtgatcgtggtagcgttaattccgctcatatatcattgtaaaatatgggttttatatgaactataatgctttcgtgataatacgctgcgtgtattaggcggaaaaaactgatctgggggatgtagaaactcaaggaagtagctataatgcgccccgcctccatgtagcaatcgaggcgcggaagatcgtcgtctccggtgaggcggctggacttcaaatccagttggggccgccagcggtcccgggcaggttcgactcctgtgatcttccgccaaaatgcctctcctgacgttctccaaccccttgtaatactgtcaatccagatattttctactgctcaatattcaatcggcttcaggaatacctggtctaaggttttgtgatggacgatgagcggctgaagaatccgcctgtcggttcttctgtcctcgaacgcatccgcgatattcacgccagtatgcgccgtgtttatttgcaggtgatttgcccccctgctgactctcagccaactgtatcgccattaaggtgaagatgttgttttactcgccccagaacacccttttttatacgactattctatttctttaaccgctggcgaaaaaaactgactataaacttcaccaataatcagactgccatcaagattaatttgttcatttaatatatcaaatcaacttgttttatttttactatcaaaaatagctcattgccttactataattaatatataaattcggtaattaattcttaacatgcttttactaataatctcaattgctggccctataatattgcgctagcattgctttctggttgtatcagcgatactcaaaaattcttaatacaatactcattcgactggtacttatttgtaactcagttatattttttcgcccggtgattcagaagaatgcaaaaaacggctaccactccatcaaaaatacttgatctcactgccgcggcatttttacttgtcgcctttctgacgggtattgcgggcgctcttcagactcctaccctaagtatattcctcgcagatgaactgaaagcccgtcctataatggtaggttttttcttcaccggtagcgctattatgggaattctggtcagtcaatttctggcaaggcactccgataaacaaggcgaccgtaaattactgattctgctatgttgcttatttggagtgctggcctgcacgctttttgcgtggaatcgcaactacttcattctcctctcaacgggcgtacttctgagtagttttgcttccaccgcaaacccgcaaatgttcgccctcgcccgtgaacacgccgacagaacaggccgtgagacggtcatgttcagtacatttttacgtgctcagatctcgcttgcctgggttatcgggccaccgctcgcttatgaactggcaatgggatttagttttaaagtgatgtatctcaccgctgccatcgcatttgttgtttgcggactgatagtctggttgtttttgccatcaatacaaagaaatattcctgtcgttacccaacccgtagaaattttaccctccacccacaggaagcgggatacgcggctactttttgtggtctgttcaatgatgtgggcggcgaataatctctacatgataaatatgccgctatttattattgatgaactgcatctaaccgataaactgactggagaaatgattggtatcgctgccggtctggaaattccgatgatgttaatcgcaggctattacatgaaacgtattggcaagcgactattaatgctcattgctatcgtgagtggaatgtgtttttacgccagcgtactcatggcgacgactccggcggttgagctggaattgcaaattcttaatgccatcttccttggtattctctgtggtatcggcatgctttattttcaggacttgatgcctgaaaaaataggctctgcgacaacgttatatgcaaatacttcacgcgtcggctggattatcgccggctctgttgacggaattatggttgaaatctggagctaccatgcgttgttctggctggcgatagggatgttgggtattgcgatgatttgcctgctgtttattaaagatatttagctcaccagtctgggctaagaaaaatcggcgtggcgcaaacagagccatcctcgccatttttgctatcatgcctgcatacataaacgacaaaacagtatgcagagggaaaaatgggttccaccagaaaggggatgctgaacgttctgattgccgccgtgttgtggggaagttcaggggtctgcgcgcaatacatcatggagcaaagccagatgtcgtcgcagtttttgactatgacgcgtttgatattcgccggtttgattctactgacgctgtcatttgttcatggcgataaaatcttttctattattaacaatcataaagatgccattagcctgctgattttttccgtggttggcgcgctaactgtacagctcacttttttgctaaccatcgaaaaatcgaacgcagccacggcaacggtgctgcaattcctctcaccgacgattatcgtcgcctggttctcactggtgcgtaaatcgcgcccgggcattctggttttctgcgctattttgacatcgctggtcgggacttttttattggtgacacacggtaatccgacgtcattatcgatctctcctgccgcgttgttctggggcattgcctcggcatttgctgctgcattctataccacctatccctcaacgctaattgcccgctatggcacgttaccagtcgtcggctggagtatgctgattggcggtctgattctgttgcctttttatgccagacaaggaacaaactttgtcgttaacggcagtttgattctggcgtttttttatttggtggtcattggtacgtccctgacatttagtctgtacctgaaaggagcacaattaattggcggtccaaaagccagcattttgagctgtgcagaaccattaagtagcgcgctactctctttgctgttgctggggatcacgttcacattaccggactggctgggaacgctgctgattctgtcatcggtgattttgatttcaatggattcccgtcgccgcgccagaaaaataaatcgtccggcgcggcataagtgagaattaccagccaggcaccgcgccaccgttaaaaatggtttctgccgctttagcgacttcgggtgattgataagattgcagaaattccttcacgttttctgcattcttattatcttcccgtgccaccaaaatattcacatacggcgaattcttatcttcaataaatacgctgtcgtgcaccggagaaagcccggtctgctgaatgtaagtggtgctgataatcgctacatcaactttgggatcatccagtacgcgcgggagctgcgccccctcgagttccataatctgcaaatgacgaggattatcggttatatccagcgcggtaggtaataacccttttccctctttcagagtaattagcttctctttttgcaacagtaaaagtgcgcgaccaaggttggtcgggtcgttggggatcgccactgtcgcgccttcttttatttgcgccacggttttgatttttttggaataacccgccatagggaagacaaacgtatttcccaccgctaccagtttataaccatgcgcctgattatcttgttcaagaaagggtcgatgctggaagacattcgcatcaagttcgccatgatttgtcgcatcgttcggtagcaacgaaccgctaaatcctaccagttcaacatcgaggccatatttctcttttgccacctttttagcgacttccgcgacatcttgttctgcgccatttataacgccaactttaatgtgttttgcatcgctgctactctggtcgcaacctgccagcagaattccggccagcaataatgcggcccctgtccgtagatgatgtgttgtcagtttcatttttttatccttttattaatgattacctgactatagcggtaaggtcgctgcggtttaaaaaacgaaacgctatcgataagaataaaaaggaataaaagtggaatataaagtctggcacttcttactgaccacgcaagcgcgtttcgtacagcatgatgagagcgatgaaagcaaactacacttatgcttcattcgatacacatttgtaaaaggttgaatccatgaaaccaacgacactactgcttattttcacttttttcgctatgccaggcatcgtatacgccgagtcgccttttagctcactgcagtccgcaaaagagaaaaccacggtattacaagatttacgtaaaatttgcacgccacaggcgtcattatcagatgaagcgtgggaaaagttaatgttgtcagatgaaaacaataaacaacatatacgcgaggccatcgtggcgatggaacgtaataatcagagcaattattgggaagcgttgggtaaggtagaatgcccggatatgtaagaacagcaacaactactgaccaacgcttctttacctgatatcaggatttcttcattttcacctttgcagtaaccaacaatgcagtcagcaacatcaatgtgccggacaacatcaacggcgaagtcagaccaatattatccagcgcataaccgccgattgccgcgccacaggtattagcaagctgaataaccgccacctgaatagacccggctttttctgcctgatcggccagcgagcgggtgatccacgttgaccagccgacgggaaccaatgcaaaagttagcccccagataatcgccacgccggtagcaacgattttatcgcttccccacaacgtcagtaccaacgcactcacagccagtattaacggcgcgcctgctaaggccagttttaccgaacgtttaagaatgaacgacgaaagcgacgtaccaataaagctggcgataccaaaactcaacagcaccagcgttaagccatccacgccgaatcccgccaggttcatatacaccgggcgaatatacgtgaagaaagcaaactgcccggcgaaagacatgaagatggcgatcatccctgccatcacacccggacgttgtaataagcggaaagtattttgtttctgatgcgagggttcgcctggcagtgaaggcaatgatttgataatccagaaaatacacagcacgcccatcaccgccgccgcattaaagacattgcgccaaccgataagctcgcctaaaaaactgcccaacggcgcggcaatcaccagcgcaatagaaaccgcgccgaagatcaccgacagcgccttcggcaccgtacgcggcggcaccagacgcatggtcagcgacgccgacatcgcccagaacccgcccagcgccagccccagacaggcacgaccgattaaaagcaaactgaatgagttagcaaaggaaaccagcaagcaggagagcgtcagcaaaacggcaaacaaaataacaacgtagcggcggtcagtagcctgaattgtctgggtaataaacaaactggcaaacattgccacaaaggcggtcacggtcaccgattgcccggcaaccccttccgaaatgcctaaatcctgggccattggcgtcaacaaactgacgggcaaaaactcaacgataatcagacaggcgacacaaaacgccaccgagaaaacggctgaccagttcggtcgggtgatggcatccgcgccgcggttttcggcaataaattcactcatggtgttacccgtggcatgtttcaggggaaaagccgaccactttaacattgaaatgtgtgacgcatttaacgtttttgcaacttttacggtgttgcttgagctggagttaagatcgaaacggaacagggcaaagattaccggatgcggcgtgaacgtcttatccacccgacaggtcaggcgcggtctgtaggctgataagacgaaacggtttcaatgcaaccagtgaacgccctcggcaggctgaaagaacgcgttatagcgcatctgaaaagcattaatatcctgcatttcaggttcggtttcgcgcagaaaacctagcgccagcctgacctgagcgtcggtaatcggcgcggcgaggcgagctttttgtaaaatccgatgccattgcagcaggttctgttcgctaccatcgacaatgacaatttgccagatgagcaacacctgcgcggcgttttgcaggtgcgactcatccggacgatgcaaataacgtaaaaattcgtcaccagctgactttcccatttgatcgaccatcgactccacgggtacgacatcgatgttcagccgatcgctgagacggcgaatcgcttttctggccccggatgtcagcacccgaaaaccaaccacaaacactaccgccagcgtggcgagcattatccagatcatgagttctcctgcgtaatcagaactcatgatatctggaaaccctcgccagttactaatccaccagaataatcttcagtgcaaacagagctgcgaccaccaccacacacaggttcagatcgcgccagcgcccggtgcatactttcatgatgcagtacgacataaagccgagtgcaatcccttcggtgatcgagaaagtaaagggcatcatcaccgtggtaataaacgcaggcaccgattcggtaaaatcatcccagttaacgcgcgccaggctcgaagtcatcagcacgccaacaaagattaacgctccggcggttgcgtaaggaggaactatcgccaccagcggtgagaagaacataaccaacaggaacataacgccaaccacaaccgcagtcagccccgtgcggccaccgactgccacaccagaagtactttcaatataggcagtaacagacgaggtgccgataaacgcacccgccaccgaactgacgctatcaacatacagcgccttattcatattggggaatttaccgttaccatctattaagcccgctttatcagttacaccaattaatgttcctgatgaatcaaataggttgatcagcataaaggagaaaatgataccggcgagttcaagtgttaacgcgccgctcaaatctacttcaccaatgacgccgctaatatcaggcggaatggaatagacgccgctaaaatgaacatcaccgaaaaataatccacagcaagacgtcaccacaatagaaaccagcaccgcggcatgaaaatgacgtgatgacaacacggttataataaaaaaccctaaaatacctaacaacacgccgtgagaacttaaatcgccaatcatcaccagcgtgtctttattggcgacaataacgccagtattttttaatcccattaaggcgataaataatccaattccgctggtgataccaatacgtaaacttaagggaatgttggagatcatccagtaccggatacgaaacagcgtgagcaaaaatagtccaactgcgccccagaatattgcgcccatcccggtctgccaggagatgcccatcgcccccacgaccacgaaggcaaagaaggcgttcagccccattgccggagccagcgccacgggtaagttagcaaatatccccatcgcaatactgccgataccggcaatcaaacaggtggtaacaaacaccactttcgggtccatttgtgccgcgccgaggatttgcgggttcacaaaaacgatgtacaccatggttaaaaaagtggtcatccccgcaatcaattctgtgcggacggtggtcccatgctgaggtagtttaaataatcgcgaaagcgtccctgattcattactcacgtaatcggtattgtcattattcatttttttgtccattggaggagatttaatcccttgcttttgtaaaacaaatgacaacaacggttcagtgataattatcacatttcaattgcacattaatggatattctttaataatctcgcgacgtttctttatgataaataataatcaaattgataaaatcaaaatgagaaaaatatgaataattctattaaccataaatttcatcacattagccgggctgaataccaggaattgttagccgtttcccgtggcgacgctgttgccgattatattattgataatgtctctattctcgacctgatcaatggcggagaaatttccggcccaattgtgattaaaggacgttacattgccggtgttggcgcagaatacactgatgctccggctttgcagcggattgatgctcgcggcgcaacggcggtgccagggtttattgatgctcacctgcatattgaatccagcatgatgacgccggtcacttttgaaaccgctaccctgccgcgcggcctgacgaccgttatttgcgaccctcatgaaatcgtcaacgtgatgggcgaagccggattcgcctggtttgcccgctgtgccgaacaggcaaggcaaaaccagtacttacaggtcagctcttgcgtacccgccctggaaggctgcgatgttaacggtgccagttttacccttgaacagatgctcgcctggcgggaccatccgcaggttaccggccttgcagaaatgatggactaccctggcgtaattagcgggcagaatgcgctgctcgataaactggatgcatttcgccacctgacgctggacggtcactgcccgggtttgggtggtaaagaacttaacgcctatattactgcgggtattgaaaactgccacgaaagttatcagctggaagaaggacgccggaaattacaactcggcatgtcgttgatgatccgcgaagggtccgctgcccgcaatctcaacgcgctggcaccgttgatcaacgaatttaacagcccgcaatgcatgctctgtaccgatgaccgtaacccgtgggagatcgcccatgaaggacacatcgatgccttaattcgccgcctgatcgaacaacacaatgtgccgctgcatgtggcatatcgcgtcgccagctggtcgacggcgcgccactttggtctgaatcacctcggcttactggcacccggcaagcaggccgatatcgtcctgttgagcgatgcgcgtaaggtcacggtgcagcaggtactggtgaaaggcgagccgattgatgcgcaaaccttacaggcggaagagtcggcgagactggcacaatccgctccgccatatggcaacaccattgcccgccagccagtttccgccagcgactttgccctgcaatttacgcccggaaaacgctatcgggtcattgacgtcatccataacgaattgattacgcactcccactccagcgtctacagcgaaaatggttttgatcgcgatgatgtgagctttattgccgtacttgagcgttacgggcaacggctggctccggcttgtggtttgcttggcggctttggactgaatgaaggtgcgctggctgcgacggtcagccatgacagccataatattgtggtgatcggtcgcagtgccgaagagatggcgctggcggtcaatcaggtgattcaggatggcggcgggctgtgcgtggtacgtaacggccaggtacaaagtcatctgccgttacccattgccgggctgatgagcaccgacacggcgcagtcgctggcggaacaaattgacgccttgaaagccgccgcccgtgaatgcggtccgttacccgatgagccgtttattcagatggcgtttctttctctgccagtgatccccgcgctaaaactaaccagtcaggggctatttgatggcgagaagtttgccttcactacgctggaagtcacggaataataaaaaaagcccggcgtcatgccgggcaaaagtcaccagttacgtttatgccactgtcaactgctgaatttttttctcgcggcggattttgcgttcttccattaccgccactatcgccatcaggcagatacaaccaatcgcggcgatatccagcgcggcgaaggtgcctgcccagccggtaaggccgaataccggcgtcccatcggcaatcattcccagacctaacttggcaaagctgtcaccaatcaggtaagcaaaggtgcctttaataccatcggcagcgccaatcgcttttttaggtacaaagccaacagcagccacaccaatcaacaattgcgggccaaagaccaggaaacccaacgcaaagagagaagccagatagatatattcgttactggcatgttgatacacaccgagcgtggcgataatcagcgccagcgcgatgcaggccaccaggccacggcgaccgttcgccaggtcagagagccagccccacagcagcgtaccgaccagcgcaccagcttcaaacagcgtaaagccctgaatcgccaccgctttagagagtttcagttcctggaacgcgtatacggttgaccactggtcgataccaatacgtaccacatagaggaaaatgttggcgaagcacagcagccagatcactttgtttttcagcacatactcaacaaagatctgccacttggtcatatcggtagattctgtctctttgtcctcttcgctgatctcctcgccgaacagttcttcagctttgccgaggccataagattccggggagtcgctgccgtaacgcaggccgataaaaccgacaatcagcgcgataatcgacgggaagataaacatgccgatgacatggccatcgaacaggtaatttgccccgaacagcgccacacctgctgcgcctgcaccgccaaggttgtgagaaatattccagaaaccgaggaatgtcccgcgtttacgacgcggcgtccatttggtgatggtggagtaactgcacgaaccgccggtactctggaaaaagccgcttaaggcgtagaaggcaatcatcaggaacaggctaaccgagccgctgcccatactggcactgaagcccagcatacaaatagcagagaggatcagcatgaacggcaggaattgtttggtgtttttgccgtcggcgtagtaggaaaccagcgttttacccacgccataagtgatggagaaacccaggccgatcatccccagctgcgtcatgctcaacccgtaggtcgaaatcatatcgttctgcgcgatgttaaagttcttgcgaatcaggtacatcgtcaggtagccgataaagaccaccaggtaggattgcatgaacggtttgaaccacattttgcgccgcacttcgagcggaaggtccagggtcggcttgcgaacctggtttaagaaagccagcatgggttactcctgaaatgaatacctgcgtgaggcatgcattgtaaaaatcagcagcaaatcaggcctgagatagcgtccaggcaaaacctggaaaatttcttagttttgccggatatgaagtgaaaaggtgagatgcatcacgcttcgcgcggtgtctgggcgttcaaaaagggcagtaacagcagtgcggaaatcccggcggcgatagagataaccacaaaaaatccgctccagtgccaggtatcgagtactttcgccagcggccaaccagcaagcgacgcccccagataagcaaacaagccgacaaaccccgtcgccgcccctgccgcctctttgtgggaacactctgccgccgccataccgattaacatctgtgggccaaagacaaaaaaaccaatggtgaagaagcaggttgcctgcatcacgtagctggcaaatggcatcagccacagggagccgactgaaagcaaaattccggcggcgaaaatcaaattcatcggccctcggttgccgttaaacaatttgtccgagccccaaccggctaccagcgcaccgataaatccgcccagttcaaacatcgtcactgccgtattcgccgtgaccagatcgacgcccagtgtctcggacatatacaaattgccccagtcgttgatcgccgcccggaccacatagaccagcacatagcaaaacgaaagcagccagatatacggattcagcaacacatatttggtgaggatctctttacgcgtcaaccctgccccttcttgttgttgagcaatttccagcgcgtcgtgtcgccattcaccgaccgccggtaaacctaacgcctgcgggcgatcgcgtagccgccagcagagaaaaatccccacgactatcgccatacaaccagcaatcatcatcccggcacgccagccgtaatgcagcgcagccgctgccatcacaatgggaatgagtgcgccgccgacgttatgcgccgtgttccataatgcccaccaaccgccgcgctcggtacgtgaataccaggccgttaacagacgcgcacacaccggtgaaccccagccctggaaaaaggcgttcagcacccagagcacggcaaacgcccatagcgacgtcgagaagccaaacagaatgttgataatgcccgtggcgataagccctatccccataaaataacgggcatttgagcgatcgctgacaatgccggagacaaacttcgacacgccataggtaatgtaaaacagggtcgctaacaggccgatatcgctacggctgagcacgccgttagcaaggatttctggtacggcggcgttaaaacttttccgcgtgaagtaaaacagcgcgtaacccagccagatggtcagcagaatatgccgacgccagtagcgatagcgggcatcaatttcatatttatcagtcattaatggcgcatcggcaggcgctttcagaaacggcaacatcatcaaaccttagacatagcgttgaggtagagaaacgctgacacgcgtgccgtgcagacaggaaatgtgtaatgtgccacccagcgccgttacgcgctcgcgcattccggtgaggccaaaaccttgttgcccggaacccggcggcaaaccgctgccatcgtcttcaataaccagcatcaaccgttcatcctgctgccagccttgcagggtgaccgcgctggcatcagcatgtttcacaatgttgttcagcccttcctggcagacacgaaacagcgtcacgcgctggttttcgcttaacgctgattcatcgattcgccattcgagatggctgacaataccgcgcccttccagctccatttcccgcatcagtgagcggatggcctgctccagggtgagatcatccaactggcgcggacgtaaccgacccaacaaacggcgcaccgcgtcgtaaacgcccagcgatagttgttcgatgagctgcccgctctgcttcacgctggcgttatctgccgccagccgctgaacaatgcccgcctgagtacgaatagcagtgatggtctgaccgatatcatcatgcagctcacgcgccacatcacggcgcacgctctcttcggtttccagcaaccgttcagccagatgctgattgcgcgccagttccttttgcagcgactggttaagttcacgcaaccgctggatgccagcgccaagcaacaaccctgtcagactttgcaccagcagcgagagcaataaatccaccggatgatcgcgccaggtttgactggcgatcagcgcgatggcgttcatcaacgtcgcaatcagcgccccttgccaaccatagtgccaggccagcgcgataatcggcagcgccagacagaatggcgtaaagcgcgacagttcgtccggcaatcccaactggagccagagactgataacaaacagcagcaagtaccagaccagatgtcgcccgcgccagttgattggctgagaaaccagtgacggaccgagcggcagccaggtgttattggcgagatagtgccagaacaccagacatatcggggccagcgtcaggccgccagttaaagtcagcaacagcgcattccacgactctttgccgtgccaaagccagggcagcgactgcaacaacgccgccgccgttaacgccgccccctgtaacagcaaggtgcgccagtcacgctgatggcgatagcgcgagatcagcgctacgggcagtaacgtcagtaaactaccgatcatcaataacggaaaatgggttaaaccgaccgcctgcgttagccagtaaatcagcagccactccgcgcccagcaatacgggccagtatccgcgcgggcattgcagcattagccccagacgcagaccaaacggaaataacagcaccgccatatcagggcgctcaaccagatgcaggctgatactccacaggcaaaaccatgcggcagagaagataaaaaagcaggcaataacggtaattaagcgggagaacaacgtcttcatcaccagccatcaaacatgcggcgcgccagctctacgtcgttactgacgcccagtttttccatcagattggcgcgatggacgtgtaccgttttcggtgacaagcccagttcggcggcaatctctttcaccgccattccttgcgccagtttttccgccacctggcgttcacgtttggttagcgggtcctgacgaccggatgccagtttaatggcaatatccggcgtcagataacagccgcccgtggcaaccgtatgcaccgcagcaatgagttcatccgggctacagcgtttggaaagaaagccgcgtgcccccgcgttaagcgcctgctcaaccagcgcaggactgtcgtgaacggagagcataatcgtcgccatacctttcggcagctggcttagcagctccagaccggagatatcgggcatggagatatcgcaaatacacacctgcacaccgcgccccggcagccccgccagcgcctcgcgccccgaaccaaactcggcaactacctgcaaatcaggttccagccccagcagctgcgcaaagccggagcggacgatgaggtgatcgtctataagggcaacggtgatcatggtcttgtcctggcgggtaaaaaaaatacgcgcttaccttaacgataagcgcgatgttgttcaagccttgagcggttactgaaaaaacaccgcgatcttgttaaacatcgtcggatcggactgattacgctgcactttcacgacatcttccagcttatcgatttggcttatcatctgctccagacgctggtcgtcattgaccagtagccagatatggcttttgtcgctgtcctgaatcggcagacaaagaatgccttcaacgttaaaagcgcggcgggcaaaaaggccacaaacgtgggtcattacgcccggatggttgcgaacggtgagctccagaattacgttgtcatgagttgtgttttgcatggcttattcccccaccatttcagtattcgccgcacctggcggcaccatcgggtaaactttttcttcggcatcaatgcgcacatggatcagcgccgggccagggcgattgatgatttcctgcaatgaagcctgcggatcggcttcgttattcaaatcacaggtttcgaggccgaatccggcggcaatctgcataaagttgattttgcccggataggtggcggcaaaaacgccttgctcgtagaacagactctgttgctgatgcaccagccccagcgcttcgttgttcatcagaatgattttgacatccagctgattttcactggcggtcgccatctcctgaatattcatcatcaggctgccgtcgccggagaaacacaacactttgcgatccgggttcgccagcgcagcgccaatcgccgcaggcaggccaaaacccatcgtgcccagcccaccggaggtcagccactggcgtgggcgattgagcggataagcttgcgcggtccacatctgatgctgaccaacgtcggtggtgataattgcattgtcatcgacacaggcggcaacggcgttgatcaggccgtaatggcttaacggatcgcacgctttcgggattggacacggaaactcacgctgcaaatccgctaccaactggtgccactctgcacgcggttgcgcttccaccagcgggatcaactgcgccagcacgtcatcaacatccgcctgaatcgccacgtgcggctgcttgattttacccagctctgcacggtcgatatcgacatgaatgattttggcattcggacagaactgctcggttttgccaatcgcccggtcatcaaaacgcgcaccgagcactatcaacaaatccgcctcctgcaaaatatagttggtgctgcgcacgccgtgcatccccagcatacccagcgacaacggatgcgcttttggcaacatgcccagcgccattaaagtcatggtggtaggcagttgcgctttctccgccagttcacgcacccgtgcgggcgcattgatcacaccgccgcccagataaagcaccgggcgtttggcagcgttaatcatcgccgctgcgtcacgaatgctttcttcgctaaaggcgggggcggcggctttttctgccatagcgggctgtgtttcaatctcaaaaactgccgtttgcacatccttaggaatgtctatccacaccgggcctgggcggcctgattgcgcaatgcggaaggcatcgctcatgacctgcgggagttcttcgatatgtctgaccagatagttgtgtttggtgatggggatagagatgccgtaggtgtccacttcctggaaggcgtcggtgccgatcatcgaggcgggaacctgaccagtgatgcaaatcagcgggatggagtccagccgcgcatcggcaatggcggtcaccaggttagtcgcacccggtccgctacaggccatacagaccgccggtttaccgtcggtgcgcgccattccctgagcgataaagcccgcgccctgttcatgacgggccagaatatggcggatttgcgtgctttggcttaaggcatcgtaaacaggcaggatagaaccgcccggaatgcctgtcacaatcttaatgccctgctgttccaggaaatgaacgataaattctgcgccggtaaagcgcttacgcgtcgatgttgtgcccgaacttgccatgctccagtccttttcttctgggccgactttccgggaggtgcttaaacgaaaaaccccgcccggtttgcgccggcggggttttggaatcgtgtgttgttccagtccctacggcgcattgccgacgaccaccaccacacgcacgacgaccactgcggcggatggcgcagttggtagtagttttgcgttgagcatggaagtagtcattggggaccttgttggttttgtgtttaacaatatttatacaagcacagctttacaggggagacaatggaaaatttttcagcaagggaaaattgaggggttgatcacgttttgtactgaattgcagataacaaaaaaccccgccggagcgaggtttcgtcagtcgcctgcggctggtaaccgcaaagcacactgtattatgtcaacactgaaagtatacgtgttccgcgcagaacgcgcaatttcggcacgaattttgacgtatttagtgcatagttgagtatcgatcacagtttgcgttttgtccaaatattactgtttatttatacagtaaacttctataatatcactgtacgcaatgtgttatgcgggggccgcatcgttacccggcgcactaagtcctggctgaaacgggtggtgccgtcagcgccttaaccccgcgtgagcacactgtgttatgtcaacaagcacaacgtttctccttgagataccgcgtgcacaacagctggcaacaggcagcggaaaggtacgtcagctggcagtgctcctgaaccacaggagacgcgtatgaacctggtggatatcgccattcttatcctcaaactcattgttgcagcactgcaactgcttgatgctgttctgaaatacctgaagtaattcagattcaagtcgcaccaaaggggagcgggaaaccgctccccttttatatttagcgtgcgggttggtgtcggatgcgatgctgacgcatcttatccgccctaccatctctcccggcaacatttattgccgcttttgtttacatattctgccgctaaacaattccccattcctggcgtatatctggctaacattcatcaatgtgatagattcctctcccgcatttatgggaatgcgtagtgacttattctaattatttttataaaagcatccgtgataatgaaaaggcaaagaaacgtcaatttgttattgatgttggtattactcgtggccgtcggtcagatggcgcaaaccatttatattccagctattgccgatatggcgcgcgatctcaacgtccgtgaaggggcggtgcagagcgtaatgggcgcttatctgctgacttacggtgtctcacagctgttttatggcccgatttccgaccgcgtgggccgccgaccggtgatcctcgtcggaatgtccatttttatgctggcaacgctggtcgcggtcacgacctccagtttgacggtgttgattgccgccagcgcgatgcaggggatgggcaccggcgttggcggcgtaatggcgcgtactttaccgcgagatttatatgaacggacacagttgcgccatgctaacagcctgttaaacatggggattctcgtcagtccgttgctcgcaccgctaatcggcggtctgctggatacgatgtggaactggcgcgcctgttatctctttttgttggttctttgtgctggtgtgaccttcagtatggcccgctggatgccggaaacgcgtccggtcgatgcaccgcgcacgcgcctgcttaccagttataaaacgcttttcggtaacagcggttttaactgttatttgctgatgctgattggcggtctggccgggattgccgcctttgaagcctgctccggcgtgctgatgggcgcggtgttagggctgagcagtatgacggtcagtattttgtttattctgccgattccggcagcgttttttggcgcatggtttgccggacgtcccaataaacgcttctccacgttaatgtggcagtcggttatctgctgcctgctggctggcttgctgatgtggatccccgactggtttggcgtgatgaatgtctggacgctgctcgttcccgccgcgctgttctttttcggtgccgggatgctgtttccgctggcgaccagcggcgcgatggagccgttccccttcctggcgggcacggctggcgcgctggtcggcggtctgcaaaacattggttccggcgtgctggcgtcgctctctgcgatgttgccgcaaaccggtcagggcagcctggggttgttgatgaccttaatgggattgttgatcgtgctgtgctggctgccgctggcgacgcggatgtcgcatcaggggcagcccgtttaagcgcacgtcaccgcagcatcgtcatcagctccatgggagaacgatgctgctttatcagatcacgcatcacccgcatatgcggtgcggagtaagaataaaacgcctgatagcccgcacaaagcacgctgtctggcgtctcctgccgagcgtgcgggcacaggcgatgccagtcgcacgcctggcagtcacagcgcggttgcgggttttcgctgccacaccatttttgtaaggtggcgtcaaaaagctcaatcgagatacgactgatatctgcccgcacccaacactcgaacagggcaattaaaaatttcccccacagctctgctgtcaccgaagcggccgtcagatcgccccggtcatcaaattcaagatagggaatgagctgtacggagcggatgccccgctgtttgaaattgtgataaaaatcggcaggttgcagagcatccttgtactctacaaccagtttatgcctgtcctcttcagcatcaatgacctgacttcctgtcatgcgactctctcaataaatacgataagttgatgtatatgcgttacagcaaacagtattgcgagagataacaccgcgagggagatcaaaaatttgtcacggactacgtgaaattgggaaaaatcgctattcgtgacatccattaaattgcgattacgggtgtagtgccagaggatcagcgccacgatggcgagaatgccaatcgaaatccagaataacatgcccgcctggtgccagttgtgtttgatagccaacgccatcaacgcgccgtagcccagcatggtacgaaaccacgccagtgatgtgcgctccggctgcagtcctgggtcggcaatgcgtctggctttgcggctatccggcatacaacaccagtcccataacgatcaccgccacgaccatcaatattaagctaatgattaataagctgttggtgtagggcaggtcctctttcagacgcatcgctttttcattgcgtaaccagcgcaagtagccatacatcgctaacccgccggaaaacagacacaacaacaacgccagcagttcgcgaatgacgggcgtggcgaaatctggcgcaagttgatcaagcccaacccccgccgccagaaatcctagtgcagtacggatccacgccagaaaagtacgctcattagccagcgagaagcggtaatcaggcgcttctccgaggcgggaaattttcattgttgctcctttgcaatttcactaacgctctacctttagcggtttttttaagaatttcgtccgcccgtttcctgatatgcttttgccatccgctacaaggaggtcagatgggtatcatagctcaaaataaaatcagttcattgggcatgctgttcggtgccatcgctttaatgatggggattatccacttttcattcggccctttctccgcaccaccgccaacgtttgaaagcatcgtggcggacaaaacggctgaaattaaaagaggtcttctcgccggaataaaaggcgaaaaaattaccaccgtggagaaaaaagaggacgtagatgtcgataaaatcctcaatcaaagcggtatcgcactggccattgctgcgctactttgcgcatttattggcggtatgcgtaaggaaaatcgctggggcattcgcggcgcgctggtttttggcggcgggacgctggctttccataccttgctttttggtatcggcatcgtgtgcagcattttgctgatattccttatcttttccttcctgaccggcggttcactggtttaagcagcctgaataatgcccgccgggtgatcatcagcgggcattatcgtcagaacttctgttttttctcctccaccttcaccccttgtgtcggtaggccggtgtcatagtcgcgtacaactggcgaatagccatcttgtggacgtggacgaaacgcccccatccagcgcggccgtgcatctttacgccacggacgcagactccattggtaactgcggaacggatcgcgaattttgtccatgtaatccaataaggcgtcatgcattttgctgcgaacgtctgcaaaacggatatcatcgatcaggttatgcatttcatttgggtcattacggcgatcgtaaagttcatcactggtgaagaggttgagtaccagtttaaagtcatccgtcacccagcaacgcaccggaataaaaccgccaaagctgtcatgctcaatctcgtagcggttaaattccaccatcacgccgcgtggctctttcacggcaaggatattttcccccggcagaatctctggtttttcaatatctgccagcgccatcattgtcggcagtaaatcgatatgactgactggcgtatcgacctgtcgccgctccccttgcggcgaacggatgatcagcggaatgcgggtgatgtcgtcatacatcgccgcccctttactgatcagcttatgtgcgcccatcatttcgccgtgatcggaggtataaataacccacgtattttcacgttgctctggcgttaaggcattgatgacccgtccgatttggtcatcaacaaagtcattacaggcaaaatagagcggatggtgataaagcccgtcatcaccgactggcgatggcatcgcctgcgcccataagcggtgatgttccggtttgttagccaggtcatcctgtgctttctcgcccagctcgtagtaaaaatcagcgtatttctctaaatactccaccggacaggtgaacgggtgatgcggctcatcatacgaaaccaccatcaggaaaggctcgtctgcgcgcgcaggctgttgcagaaaatccaccgcccgattgctgatacgatgcgcccaggtgaaggtttcgtcgatatggttcgcctgtaaatcttcgacgctgtttaggccattgcgccacaggctaatctctttttccgtcagttcgctaagatagttcgccccatcgaaccagtaatcagcgtcccactccggcggacactcgccagtgccgaaatagtcatgaccgtcgagatgccatttgccgatgtaacaggtgtgatagccggcatccttaaagtagcgccccatagtggagatgtttttgcctggcgcgacgttgttggtccacgggccggactggttagcgtagataccggtaaatagtccggcccgtgcaggcgtacaaaccggtgaacaggtgtaggcggaattaaagcgaataccttccgccgccagactatcaatattttgcgtattcagcggtttaccgctatagcaaccgaccatattggtggcctgggtatcggtcatgacgaacagaaaattggggcgtttcataggctatccttcccgtcgggagtaaaggttacggctgggtcgtgacgatgccgccagctgtcaaaaatcaggtagacaatcactacggcggcaatgaaataactgatcatcgctaaccagcgcgtaccgtagccgccgaattcagccagcccggcatagacgccaatcatcgcgaacaggatgccaattgacgcgatcttgacgtttttccacggtttcatgtccaccgcaaacgcatctttgaaggtgaacggcgtggcgcgcggtttgataaaaccgatcaccagcatcacgaccacgttgatgcagaacgtacaggccagcacatagaggaaatggaagtcgaacttcaccagatagttgatggtgatgtagctgattatgccaatccccatcgctacttttgccgccagcgccgggatgcgcgggaagaaaaagcccataatgatgatggtaaccagcggcacgttgtaaatgccgttgagctgtttcatccagctatacagcccctgcggcgcgttggcgatccacggcgcgaccagcaccgaaacgatagcgataaagaaaccaaatttgcgcccgacggtgaccagctgctgcggctcggcattctggttaatgatgcgacggtaaatacccatactgaataacgtactggcgctattcagaaagccgttgaaggtactgatcaccgcaccaaataacaccgcgccgaagaaacccaccattggcactggcagaacgttattgaccagcgtcgggtaggccatgtcggctttcggtaaatcctgatacagatgaaacgcaatcaaccctggcagcaccagtaccagcgggtcgagcattttcagcaccgccgttaacagcgcccccttttgcccttccgccaggctttttgacgccagcgtgcgttgcacgatgccctgatttgtacaccagtaaaaggtgttcaccagaatcaaaccggtaaatgccgcgccaatcggcaagggatcggtcgggccaccgattgagtttaatttctcggcgtgaacggtggtgagttgctcaatgccctgcataaagctgcccttgcccatcgcgattaggccaaataccggcaccatcaacccgccgataaccagcccaataccgttgatggagtccgccactgccattgcgcgcagtccgccgatcaccgcatacaaaattcccgccagaccaagcaaaattaccagtagccagatagccgcaccgtgagaaatctgtagcgattccccgacgtgaaacaggctgttgagcgccaacgcgccggagtagagaacaatcggcagaaagcagacgccggtggcaattaggaagcagaagtcgatgataatacgcgtcgttttatcataacgttcctccagaaaatcggggatggtggcaatgccgcgcttcagatagcgcggtaaaaagattagcgcgaggaagatcagcgtcaccgctgaagtcacttcccagcccatcaccgacatgccgcttttgtaggcctgcccggaaaggccgaccagttgttccgtggaaaggttggttagcattaacgaagcggcaataaccggcgcttttagtgaacgtccggcaagaaaatagccttgttgcgatccggtatctgttttgcggaccttccaccaggtgatcaccgccaccagcagcgtaaaaccgacaaaactcaagatttgtaacgaattcatctcatagcccttatttatgtttatgtcccggacgcatgaatatagggagaggtaaaatgcgtcgggtcaggcagtcagattcttaaaatacaaacgtcgtatccctgaacggattgttttctgttaagttcaggttgtgagcataattcgccggagggatattaaaatgaatggaaaattgcaaagttcagatgtaaaaaacgaaactccgtacaatattcccttattgattaacgaaaatgtgatctccagcggaatttctctgatctcgctctggcatacctacgccgacgagcattaccgggtgatctggccgcgggacaagaagaaaccgcttatcgccaactcatgggttgcggtgtataccgtacaaggatgtgggaaaattcttttaaagaatggcgaacaaataacactgcatggcaactgtattatattcttaaagccaatggatattcactcttatcactgtgaaggtttagtctgggaacagtactggatggaatttacccccaccagtatgatggatattcccgttggtcagcaaagcgttatttataatggcgaaatttataatcaggaactcaccgaagttgctgagttaataacttcaccagaagcaataaaaaataatctggcagtcgcttttctgacgaaaattatttatcagtggatttgtcttatgtacgcagatggtaaaaaagatccacaacggcggcaaattgaaaaattaattgccactttacatgccagtctgcaacaacgctggagcgtagctgatatggctgccacgatcccctgtagcgaagcctggttgcgtcgtctgtttttacgctataccggcaagacgccgaaagaatattacctcgatgcgcgtctggatctggcgctatcgctattaaagcaacaaggaaactcggttggcgaagtcgctgatacgctcaacttcttcgactcctttcatttcagcaaagcctttaaacataaatttggttatgcgccgtcagccgtgctaaagaatacggaccagcacccaacggatgccagtccacacaattaacgtaactctggccagtacgctttgttggcctccagcaactcatccagaatagctttggcgaccgaggcgctcggtaccgttttcgacaacgtaatcgcctgccacaggtgctgatatgaacgctgttcccaggcgtccacgaccagtttttccaccgccacttgctgactcattaaccctttctgaaactgcgggatatcgccgaccaccagtggttcaggccgtagtagcgcacgcgcatctgtttgcgatcttgcagcccaacaatttgcgccatccggctttcaataccgattggcatgtcacagatgttgaggattttcgcattcgggcgcagacgacgcgtggcttctgcgacaatggctgccgggttggagtagttgagcatccaggcatttggtgaatatttttccatataatccaccagttccaggacgccgccaatggaacgcatgccgtacgctattccgccgggtccgcaagtttcctgaccaacaacgccgtggcgcagcgggattttttcatccagttcgcgcatcgggtatttgccgacgcggatgtgcgccatgacaaaatcaacgtcgctgaatgccacttcaggatcggtggtgtaactaaacgcaatgtccggcgctttttctttaaggatgactttacaggcttcggcaatcacttcctgccgcgcaccatcgttatcataaaatttcagtgcacgaagcgggaaacggtcctgattcgccaggagcatcaacacgatgcctggcgtaaaggtgcttccaccgcctgcgacaaccactgagaatttggtcattatactgcctccgtaatggcaacattttctgctgattgatgagaattaattaagctatcgagctgttcacgcagctgagatacatgcagaccaatgatcacctgaatggcatcgccactacggaagacgccgtgcgctcccagctttttaaagacttcgtcatccagcgtttgtgacatgtcatgcagtgcaatacgtaaacgcgtcgcgcaattgttaatgctggagatattgccgaccccgcccagggcttgcaggataccggcagcctgatccagctctttttttggctctgccgcggtggtttggcctcgcgaggctttgtattcggcttttgagtagagtttcacttccgcatcttcacgtcccggcgtgcacatgttgaactgcagaatcagtgtgcggaaaaccacgaagtacagcagggtaaagcacaacccaatggcgatttgggtcagcatcatatccgcgtggttgctgaacatcgggatccagttttgcggtaaaacctagtcaatcagacctccgcccatgttgcccaccacaccaaagagatacattacggtcgacattgaggccgccagcacggcgtgtaccgcaaacagcaacggtgaaatgaacaggaaggtaaattccagcggttcggtaattcccaccagcatggcggttaaggttgcgggaatcagcaagcccgccacttttacccgattttccggtgcggcagtgaagtacatcgctaaagaaatgcccacggcaccaaagatttttgagttaccgtgcagggcaaaaccgccttccgggaacaacgatttcagcggctcggcgctcaaactgaactcttgcagatgctgcgcccagtacatctgaatgccgccttcaacagctgccggaccaaagataaactgtccgtagatgaagtggtgtaaaccggttgggatcagaatacgttcgaggaaggtgtaaacccagaccccaagtgcacccgccgaacgcaggaacgcttgcagagattcaatccccatttgtacttttggccagccgagcaacgtcagccaggcacaggggatcatcaccaggaaggcgataatcaccacataagacgtcccctggaaaatgccgagaaaaaccggcagttttttatcgaacagacggttatgcagcgccgtcacaatgccggaaatgataattgcgccgataatgctggtatcgagggttttaatcccggccatcattgtcagaccgctacctgccaccgcgtcctgagtgaaatcgacgccgaagtagcttccccaggtcattcccatcgcgttgatgaaatagttccaggtcaggaaactcaccatcaccgccagacaagcacgcccctgcgcttgcttagcaaggccaatgggtaaaccgacagcaaaaatcagcggcatattacggaataccgtccaaccgccctcttcaataatgtgtacgatttgcgcgaataaactgttcggatcggtcagtgattccccgacaaacatcgggttttgcagcaagatggcaagacccaccacaatcccggcgaagggaaacagcagcactggcgtgaacatcgcgccgccaaagcgttgaatttgactgagcatttccacatcctcttttctcaattctgtaagtaggaagcctgattggttatgcggcaggcctggagcgaggataggaagatgcgatcggcagaacatgacgacccaatgggattcgtgatcgctttcatgcttttcgttgggcggtagagatctacgttttcgcgaaaaagtagacctctgtgagcacaggtacacagcatcgaacacatctttaaaaaaaagatgttttttcaatcgattaagcagaacttgtgtgcgcattacccgggcttgcaggcaaaaaagagatctagagatgatctacaaaagcattgcggagcggttaagaattcgacttaactccgcagatttcacgctaaacagccttcttcccggtgaaaaaaagctggcggaagagtttgcggtatcgcggatgaccatccgtaaagccattgacctgctggtagcgtgggggctggtggtccgccgccacggtagtggcacttacctggtgcgcaaagatgtactgcatcaaaccgccagtctgaccgggctggtggaggtgttaaaacggcagggaaaaacggtcaccagccaggtgctgatttttgaaatcatgcctgcgcctccggccattgccagccagttacggattcaaatcaacgagcagatctacttctcccgtcgcgttcgttttgtggaagggaaaccgctgatgctggaagacagctatatgccggtaaaactgttccgtaatctttcgctgcaacatctggaagggtcgaagtttgaatatattgaacaagagtgcgggattttgattggcggtaattatgaaagcctgacgccagtgctcgccgatagactgctggcgcggcaaatgaaggtagcggaacacacgccactgctgcggatcacctcgttgtcatatagcgagagcggggagtttttgaattattcagtgatgttcagaaatgccagcgaataccaggtggagtaccatttacggcgactccacccggaaaagagttaaccgatactccagaagagcaccgccagtaattggggggtgataatgcgcaggaacattaccaacggatagacagtggcgtaagagagcgccgccgcaccgctggttggatgaagattattagcaaacgccagcgccggaggatcggtcatggaacctgccagcatcccgcacatggtcaggtaattcattttggctaacatccgcgccagaatgccaacagtaatcagcggaacggcggtgatcagggcaccataaccaatccagcttagcccttcgccattgaccagggtattcacaaaatccccaccagatttcagaccaacgaccgagaggaacagcacgatccccagctcccgcagcgcgaggttggcgcttggcggcataaaccagtacagcttgccgatactgccgatacgcccgaggatcaacgccataatcagcggtccgcccgccagccccagtttcaacgcggccgggaatcctggcacaaagacgggaatagaacctaacaatacgcctagcccgatgccaataaacactggcagcatctgaacctgttgcagtttttgctgcgcattccccagcacattggcaacggcatcaattgcggacggacgccccaccagattgaggatatcgccgaactgcaggctgatatcgccactggcgaccagttcgaccccggcacggttcaggcgcgagataacaacgtcatagcgttctttaaagtgcaggtcgcgaatacgttttccgagcacgttttcattggtgaccaccacacgctcgacgcgcaaatcagtgcctttcgtggacagcgaagtatcgacctcctgaccaatcaccagttgcgcattatgtaaatccgctggctgacccaccagatgcagcaaatcgcccagttggataatggtatctggcgaaggaacttttagggtttcttcgcgtttcagacgcgagcagataattttgtcgccgttgagaatcggtacatctttaatggctaaatcatgcaggttagggttctcaacgcgaatattgatagtcttgatcagcgcgccgccattggtgcgtgaagactcgtgctgctgagcttctgtctcgacattgacgcggaaaataacccgcaacatccacatggtgaacaaaatcccgcaaatgccgaatggatacgccatcgcgtaactcatccccatctgatcgaccatttccattggtgtacccaggtcgcgcaaaatctgctgccctgcccccagcgctggcgtattggtaaccgcaccggagaaaatccccagcactaccggcagtggaatatcaaacagtttatgcaggatggcggtaaccagaccaccgatgatgacgatcagaacagcaaacaggttgaggcgtaatccggagacgcgcaatgaggcaaagaagcccggccctacctgaatcccgatagtataaacgaacaggatcaggccaaattcctgaataacatgcagcatatcgctacttaatgtcatccccgcctgagaaacaaaatggccgacgatgatcccaccaaacagcacgccgccaatacctaatcctatgccgcgaaatttgacgttgccgataaacaaaccgacgactgccaccaaagccagaatactgaccgttaatgctatatcactcatcgtccatttctcttgagataacattttaattgctacggattatggctgaatcggtgaagcagatttgccttatagcgcacattatcacgggaaagaacgtgccgaaatatcttaaacagtcgaaatttaacgcattgttgagtaagtaagacaaaaaaagccccaccagaatggcggggcaaagagaatagctagttagctatttaacgcgggacgttcgctgatagcgatacgctgcgctgcgatgggttcaggctcattacgaattaaatcaatatgcagtaaaccgtttacgaaggttgcgccagagacttccatattttcagccagcgtaaagctcaggctaaatggctgattcataagcccttgatgcagccattttttctcttcttttggctgctccggcgtgccttttacgctcaggcgcgtaccttccagttgaatctctaaatcttcctgacggaaacctgccagcgcaagggtaatgcggtagtggttatcgtcgcttttctcaatgttgtacggcgggaagctctggctttcaccggcgttttgcagtgcgttggccagtttgtcaaaaccgatccattgacgcatcagtggggataaatcgaagttacgcatagtcatttctccttctaagaagcgagtaagtacctgcaaatccgaagattcgcatatgctccctgacggcgagcatggagatgtcaggccgcgccaggcggccttagggaattagttgatttcgatacggcgcggttttttcgcttccggaatcacgcgttcgagatcgatatacagcaaaccatttaccaggttagcaccacgaacatgaatgttctcagctaactggaatttgcgttcaaagttgcgttcagcgatgccctggtacagataggtgcgctctttttgttcgtcggcgtgagcacctttcaccaccagcagattatcctgggcggtaatttccagttcgctctcagcaaaaccagccacagcgatagcaatgcggtaatggttttcgtctaccagttcaacgttatacggagggtagccgccattactctggctctggttgttttctaagtggttaaacaaacggtcaaatccaatagcagaacggtaaagcggggataaatcaaagttacgcataatcaatagctcctgaaatcagcgagaatgtaagaccttccacaatggacaggtcaggtagccagaacacccatcaggcgcgtcctcatcggctacgatgtaaaaatgggtctggaaatgaacttttcaagccttatcagcggacttttttttgcagtttatggtctattgcatagactgagggggcagcacgaaacgttaaagtgcgatagccgccacagtgcgacgtaatgatgatgttattttcagcaagggatcgctataactcatcaggccaacacccacgatcaacagatgaatttattatgataagaaatgtgttgttagcgttcatgatatgcagcggaatgacattactcggaggatgctccagcgtgatgtcccataccggagggaaagaaggaacgtatcccggcacccgcgccagcgcaaccatgattggcgacgatgaaaccaactggggcactaagtcgctggcgattctcgatatgccgtttaccgctgtgatggacacgcttttactgccgtgggatgtgttccgcaaagacagctcggtgcgctcgcgcgttgaaaaaagcgaagccaacgcgcaagccaccaatgcggttattccaccggccagaatgcctgataactgatttagcgatcagtttcggtgatccacagctggccgccttccatccacgccagccactgaccatccggcgagaagaccacggcgtccgcagaaggtgaattggcgtggtgttcggttaaatactcaacctcgccgctttgcgcatgggcacaagcaattcgattatccagcacaaagcccaaccattctcctgacggatgccagttaaatgcagactgaatatccgttttgttatgggttaactggcgcggctcgccgccctgtggcgagataagccacagttgcacaatgccgttatcatctcgcattaaaaacgcgatttgtgtaccctgcggattacagcgcacccagtggcgcgggacgttgactaaccccggataagcccgatggtgggtaaaggttaaacgtcgctgcacgacgccacgcggtggcgcgggcagggttgtttccgttccgcttaacggcgcatcacctgccgctttccagccagcttcatcttgcggtaactcaacgataaacagctccggcactttctcgccctttggcgaaagtgtgtcgccaataaatgccagcgcgtgatttcctacccatccttcttcataagcacgattgatttcatcactgccaggctgtggcgtgggcgtggttttgctcaccagcacgcaccagtggctaccgctgtattcacgcggatgctgcttttgtacgttgaccgggccaaacggcgcagcaacaccgacgtttcgcaaatccagcgccggatcgagttcatgcattacatggtcgttataggtaaagctcaccctttcaccgttcgggctaaagacatgcacatggctgccgccgcgcagcactcctggcgtatacggcgcggtaatatccatcgcatcaaggttactcatcttgccgccttcaacaatcactccgcgccgatgatggaagtcgtaatgccatgtttcatcaggattttccgggccgtggatgaaaacatatttctctgacttcggatgaacggtcaccacgccgacgtgtgcgccctgtgacgcgcgatagataacctcgacctcgccggtatggatattcacacgctcaatggtctcgccggtaaacgacgcgccagaaggacgcacgtcaaataccagccactggctgtcgggcgtccaggtattggtattggtgagcaggtgattacggggagcaaaggttatctgtttcatggcgcggtcctgatacaaaacgggtcccgccatcatacttcacaaggacttcactttcagacaatagtcttttgccatcgtgatgaatgtgagtgaaaagatggaacatttcgacgtggcgattattggcctcggcccggcaggatcggcgttggcacgaaagttagcaggcaaaatgcaggtgatcgcgctggataaaaagcaccagtgtggtactgaaggtttcagcaaaccctgcggcggtctgctggcaccggacgcgcagcgatcttttattcgcgatgggctgacgcttcctgtcgatgtgatcgctaatccgcagattttcagcgtcaaaaccgtcgacgtcgccgcatcgctcacgcgtaactaccagcgaagctatatcaatattaatcgccatgctttcgacttgtggatgaaatcgctgatccccgccagcgttgaggtttatcacgacagcctgtgccgaaaaatctggcgtgaggatgataaatggcatgtcatttttcgtgcagacggctgggagcaacatattaccgcccgctatctggtcggtgccgatggcgcaaactcgatggtgcggcgacatctctacccggatcatcaaatccgtaaatatgtcgctatccagcagtggttcgcggagaaacatccggtgccgttctactcctgcatctttgataattcgataactaactgttattcatggagtatcagcaaagacggttattttatctttggcggtgcctatccaatgaaagacggtcagacgcgtttcacgacgctgaaagagaaaatgagcgcctttcagttccagtttggtaagacggtgaaaagcgaaaaatgcacggtgctgtttccctcgcgctggcaggattttgtctgcggtaaggacaacgcctttctgattggtgaagcggcgggatttatcagcgccagctcgctggaggggattagctatgcgctggatagcacagacattctgcgttcggtgttactgaagcagccagagaagctcaataccgcttactggcgcgccacccgcaaactgcgtttaaaactcttcggcaagatagtaaaaagccgatgcctgaccgcaccggctttaagaaagtggattatgcgcagtggtgtggcacatattccacagttgaaggattagccaacgcgcttcacatcgcccaccagcaggatataagagagcgcgccaatcaacgcgacggcggagatataaaccagtgcaggtgcgaaaccgtaaccctgcgccaggtaccccaccaccagcggaacggtgatgccgcccagaccaccggcgaagttaaacacgccgccggttaaaccaatcaggcgcatcggtgccagagaagaaaccagcgaccaggtaatcgaagcaaaaccgttaccgaagaatgccagcgccatcaggcacataatcatcatcggatcgttagtgtagttagcgcccataatgcaggtggagatcagcaagccgcagataatcggcgttttacgcgcaaagcccagtgaaaagcccttacgtaccagcagatccgctacccagccagagagcaggacgccgacaaacgccgcgaggaatggcaccgtggtcataaagcctgctttcagcgccgtgattcctttttcctgggttaaatagttcgggaaccaggttaagaaaaaccacagtgtagaagccaccgcaaattgcccaagataaacgccgatcagtttacgatggaacaccagtttccagtctttggctgttaacggctgacgcgcctctttcttcaccggcgcatcaccatccaccagaccgccgccatcacgaatgtaatccagttcagctttgctgatacctttggtcaggcgcggcggctgataaaccttaaaccaaatcagcgaccagataatgccgataccaccagtgacaatgaacacccagtgccagctcaacatctcctgaatccagatcagcagcggcgtcagaaacgccagaccgacaaactgaccagacgtataaaaaccaacggcagaagcgcgttcatgttccgggaaccagctggtcaccatccggttattggtcgggaaagcaggcgcttcgaaaataccggttatcgcgcgcagaccaattaatgacattaagcccgtggcaaagccctggaataaagtcgccactgaccagccaaatatcgcaataaaataagtcacgcgagaacctacgcgatctaaaaaccaaccgccggggatctgacatagcgtataaagccaggcgaaggccgaaaatacatagcccatttccgctttggtaatgccgaactcttcctgaatatgggcggaagccacggccaggttggcgcggtcgacataacaaatgactaccgtaataaagatcatcaccagcgtcagataacgccgacgccccggctttgctgcattaacgggaatatccatagcgagctttctccagattttgggcatagcgaagccgctcaccatgccctgtaatttacagagggttatatttttgtattgctgttttagtgcccgatgaggggcttacgtggcaggaattaccactctgctacgctgttatcttcatgacgccagagcggattacgccagtccggggcatttttactgaactcaatcactttagcttcgtcgatttccacgcctaagcccggtttcgttaacggtttaaagaagccgccgaccatgctgaagtcttctttgtttttcacaaagtcgagtaactccgcgcctttgttgtaatgaattcccatactttgttcctgaagtacggcgttataggaaacaaagtcgatatgcaggcaagccgccagtgcaatcggtccgagcggacagtgcggcgcaagggtcacgtcataggcttctgccattccggcgattttgtagcattcggtaataccgcccgcgtgggagagatccggttgcagaatcgaaataccacctgcctccagcacgcgtttaaaatcgaagcgtgagaacatgcgttcacccgccgccagtggaatatgcgtttgtgccgccagtttcgggtagtattcggcttgttccgccagcaccggctcctcaataaacagcgggcgatacggctccagttctttaatcagcactttcgccatcggcgcgctgacgcgaccgtggaaatcaagaccaaactcaatctgattgccaaaagcttcacgaatttgtgccacggtgttaaccgccgcatctaccgcgcgggagttatcaattagccccagttcttcacaaccgttcagtttgaaggtatcgaagccgatttcgcgtagcgttttaatgccgtcgataacatccgccggacgatcgccgccaacccaactgtaggctttaattttgtcgcgaaccaggccgcccatcagttgccagaccggcgcattcagcactttacctttgatatcccataacgcctggtcaatcccggcgatggcgctcatcaggatcggaccgccgcgatagaatccggcgcgatacatcacttgccataagtcattgatgcgcgatggatcctgaccaatcaaatagtcacccagctcgtgaactgccgcttccaccgtacgggcgcggccttcgatcacgggctcgccccaaccgaccacgccttcatcggtttcaattttcaggaacatccagcggggaggtaaacgatacgtggtaattttggtgattttcattgcactgcctctcgatacgccttaacaaatgctgctgcctgctgcgcggtgcgctctacggattgcccggcgcgatagagatcgctgcctaagcccgcccctgcacaacctgcgtctatccactgcgccaggttttctggcgtcacgccgccaacggcaaagactgcgatgtccgatggcaataccgcttttaacgctttgatgtattgcggaccaaaagccgatgacggaaatattttcagcgcctgcgcgcccgcttcgagcgcggtaaaggcttcggtcgccgtcgcgcagccggggcagacggtcatgccgtagcccaccgcacggcggatcacttcactatggatattgggcgtaacgatgagctgacagcccatcctggcgagcgcatcgacctgttcaggtttcagtaccgtacctgcgccaatcaacgccttgtcgccgtacgcatcaacgatggcgggaatgctttgctcccattgtggggaattcagcgggatttcaaccgcgtcgaacccggcgtcaatcaccgcgccaacatgcgccagcgcctcgtcgggcgtaataccgcgcaaaatggcgatcagcgggagtttagtttgccactgcatgagcgatgctccttataccagcctgaaatgccgtgtcgcccgccaccgccgtcacgtcgcaacccatcgcctgaaaggcttgctggtagcgcgcggtcagcgatgttccggcgacaagggtgatggcgtgttgatgggccacatagtcgcgcatactggcgacctctgcgccaatcaacaaaccagagagaaattcgctgacctgttcgcggggaagtgttcccagcacatgcgaggcgcgaacttcaaaaagctgcggcaatatggcgggcgtattaagaccacgctcaaggccagctgtgaaggcatcggcagagttttcctgcggcggcaaacctgcgccaatcaatgagtgatttaacagtaaatgatgtaattcaccggtcatcacggtgcgaaaatcgttgatttgctggctatcggcctgcacccatttgcaatgggttccgggcatgacataaagagaggaaggagccagagctcgcgcgccgatcaattgtgtttcttcgccgcgcatcacattgtggttatcgtcatgagagacacataatccgggaataatccagatattgtcgccaactgacgttaattgttcgccaatagacgaaaaacaggcaggaacagataaatacggtgcaactttccagccgacgttgctgccaaccattcctgccattaccactggcgttttctcttcacgccagtcggtcgtgacttctgctaacaccgcagccggagattttccgttcaggcgcgtgacgcctgcttctgattgcctgctctccaggcagtggtcgccctgataaagccaggcgcgcagattggtcgatccccagtcaattgcgatgtagcgagctgtcatgtgatttcctttaaccttcgtgtcgagctggcgatcatggtaagcgccgcctgctctgccgcatcgccgtcctgatgtcgtatcgcatcgaacagcgccttatgttcctggagcgtttgcggcatgttggcctcatcgcccatccaggttcgttcaaaaaccgcccgctgcagcgaactgatcgcaatgctaagttgctgtaacaccgggttatgcaccgactgcagcaccgcctcgtggtagcgaatatccgcttcgttaaacgcttcgcggtcctgattgttggcaatcatctcgttcagcgccgattcaatctgcgccagatcgctggaagtcgcgcgctctgctgcccaacgggcaatcgccggttccaccagatttcgcacttcgctcatggcactgataagccgtgggtcgtagtcattttccagcacccattgcagtacgtcagtgtcgaggtaattccactggttacgcggtgccacaaacgccccgcgataacgtttcatttcaatcagccgcttcgccatcagcgaacggaacacctcacggatgatgttgcgcgaggttgcaaactcctcacagagttccgcctcagccggaagcggcgagcctggcacgtatttgccgtgaacgatctgtttacccagcgtaatgacaatgcgatcggttttattgagagtcatggagagtccttgtgctctgtatgttcttctctactttaccccgatcgatgcataacgcggcaactttgtagtaccagcgtgatgacgttcgcgtttgccgtgcgtgtaatgtagtacaaacttatattgttgtactacaatttagatcacaaaaagaacaatgcataaaaaaatgacatgcgtcgggcagaaatctgaaaagggatatcaggcgctaaacaggagggaaagaagagtatgctttcaacggcttagctactcgtttaaaggattaatcatgaagttgaattttaagggattttttaaggctgccggtttattcccactggcgctgatgctttcaggctgtatctcgtatgctctggtttcccataccgcaaagggtagttcaggaaagtatcaatcgcagtcagacaccatcactgggctatcgcaggcaaaagatagtaatggaacaaaaggctatgtttttgtaggggaatcgctggattaccttatcactgatggtgccgatgacatcgttaagatgctcaatgatccagcacttaaccggcacaatattcaggttgccgatgacgcaagatttgttttaaatgcggggaaaaagaaatttaccggcacaatatcgctttactactactggaataacgaagaagaaaaggcactggcaacgcattatggttttgcctgtggtgttcaacactgtaccaggtcactggaaaacctaaaaggcacaatccatgagaaaaataaaaacatggattactcaaaggtgatggcgttctaccatccatttaaagtgcgattttatgaatactattcacccagaggcattccggatggtgtttccgcagcattactgccagtgactgttacgctggacatcattactgcaccgctgcaatttctggttgtatatgcagtaaaccaataatcagtaagcgggcaaacgcgtttatgctgtttgcccgcccacagattaattcagcacatacttctcaatagcaaacgccacgccatcttcaaggttagatttggtgacaaagttcgccacttctttcactgaaggaatagcgttatccatcgccacaccgacgcctgcatattcaatcattgcgatatcgttttcctgatcgccaatcgccatgatttcttccggtttaatacctaacacgtcggccagtgatttcacccccgtacctttgttaacgcgtttatcgaggatttcgaggaagtacggcgcacttttcagcacggtatatttctctttcacttcctgcggaatacgcgcgatagcctggtcgaggatggcgggttcatcaatcatcatcactttcaggaactgggtattggggtccattttctccgcttcgcagaacaccagcggaatggtggcaacgaaggattcatgcaccgtgtagtagctgatatcacggttggcggtgtacagcgtggtgcggtccagggcgtggaaatgagaaccgacttcgcgagagagtttttccaggaaacgatagtcgtcatagctgagagcagtttgcgccacggtgctaccatcagcggccttctgtaccagcgcgccgttataagtaatgcagtagtcgcccggctgttccatatgcagctctttcaggtagttgtgcacacctgcatacgggcgacccgtcgttagcacgacattcacgccacgggcgcgagctgcggcaatcgcatttttaacggcgggtgaaatggtgtgatcgggcagcagaagggtgccatccatatcgatagcaatgagtttaatagccatgagttccccaggtagattggttcctgacccatgctaacgcgattccgctcaaaaatcagtacaacacccgagggaaaagggggatgcaacgcgcgttgcgtgctccctttttgcttagcggaagagtttccctttcagcagttccatgcctgcggaaagcagatcgttattggcttgtggtgacacttcaccttgcggtgagagcgcatcaataatcttcggcaattgttctgccagtaaactggaagctgtactggtatccacgccaagtttttgcccgagatcggacaccgcatttgtgccgagcgccgattccagttgctcgccactaaccgattgattgccctgttgattactcagccaggttgagagaatggcccctaagccgccactttgcagtttttccagcagcacctgaatgccgccctgctcctcaacccaacttaaaatagcctgatatttccccgcatcgcctttcagaaaggcaccgacaacttcatcaaaaagccccatgataatcacctgtaaagcgttacgtgttgacccaaaaagtatagatttgcgggatgataattgcggattgcagaaataaaaagggcggagatgatctccgcccttttcttatagcttcttgccggatgcggcgtgaacgccttatccggcctacaaaatcatgaaaattcaatacattgcaagattttcgtaggcctgataagcgtagcgcatcaggcacgctcgcatggttagcgccattaaatatcgatattcgccgctttcagggcgttctcttcaataaacgcacggcgcggttcaacggcgtcgcccatcagcgtggtgaacaactggtcggcagcaatcgcatctttaacggtaacgcgcagcatacgacgactttccgggtccatagtggtttcccacagctgttccgggttcatctcgcccagacctttataacgctggatggagaggccgcgacgggactctttcaccagccagtccagcgcctgctcgaagctggctaccggctgacgacgctcgccacgttcgataaacgcatcttcttccagcaagccacgcagtttctcacccagcgtgcagatacgacgatattcgccaccggtgataaactcgtgatccagcggatagtcagtatccacaccgtgggtacgcacgcgaacaatcggctcgaacaggttttgctcagcattggtgtgaacatcaaacttccactggctgccgtgctgttctttgtcgttcagttcgctgaccagcgcgttcacccagcgggtaacggtctgctcatcagaaaggtcagcttccgtcaacgtcggctgatagataagctctttcagcattgctttcggataacgacgctccatacgattgatcattttctgcgtcgcgttgtactcagataccagtttctctaacgcttcgccagccaatgccggtgcactggcgttggtgtgcagcgttgcgccgtccagcgcgatagagatctggtactgatccatcgcttcgtcgtctttaatgtactgttcctgcttgcctttcttcactttgtacagcggcggctgagcgatgtagacgtgaccgcgttcaacgatttccggcatctgacgatagaagaaggtcaacagcagcgtacgaatgtgcgagccgtcgacgtccgcatcggtcatgatgatgatgctgtgataacgcagtttgtccgggttgtactcgtcacgaccgataccacagccaagcgcggtgataagcgtcgccacttcctgagaagagagcatcttatcgaagcgcgctttctcgacgttgaggattttacccttcagcggcagaatcgcctggttcttgcggttacgcccctgcttcgcagagccgcccgcggagtccccttccaccaggtacagttcggaaagcgccggatcgcgttcctggcagtctgccagtttgcccggcaggcccgctaagtcgagcgcacctttacggcgggtcatttcacgcgcgcgacgcgccgcttcacgggcacgggcagcatcgataattttgccaaccacgattttcgcgtcggttgggttttccagcaggtattctgccagcagttcgttcatctgctgttcaaccgccgatttcacctcagaagaaaccagtttgtctttggtctgggaggagaatttcgggtccggcactttcacggaaacgaccgcaatcaggccttcacgcgcatcgtcaccggtggcgctgactttggcttttttgctgtagccttctttgtccatgtaggcgttcagggtacgggtcatcgccgcacggaagcctgccaggtgagtaccgccgtcacgctgcggaatgttgttggtaaagcagtagatgttttcctggaagccatcgttccactgcaacgccacttcgacgccaataccgtctttttcagtggagaagtagaagatattcgggtggatcggcgttttgttcttgttcagatattcaacgaacgccttgatgccgccttcatagtggaagtggtcttctttgccgtcgcgcttgtcgcgcagacgaatggaaacgccggagttgaggaacgacaactcacgcagacgtttcgccagaatttcatattcgaactcggtcacattggtgaaggtttcgaggctgggccagaaacgcaccatggtgccggttttttcagtctcgccggtaaccgccagcggggcctgcggtacaccgtgttcgtagatctgacggtgaattttaccctcgcgctggataaccagctccagtttttgcgacagggcgtttactaccgaaacaccaacgccgtgcagaccgccggacactttataggagttatcgtcaaatttaccgcctgcgtgcagaacggtcatgatcacttccgccgccgatacgccctcttccgggtgaataccggtcggaatgccgcgcccgtcatcctgtacagagacagagttatcggcgtgaatggtgacgataatttctttacagtgacccgcgagcgcttcgtcgatagcgttatctaccacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttatacttgggttaatccgttattttacccttttccacggtaaacatcttcgaattttcgtccgacatgtctataacgtgttcagcactgatcgcgctgacaaagacctgtgattgcgtcgcttttaagcggctggcaagcagcccgcgacgctcatcatcaagctcagaggcaaaatcatctatcaggtagagacaccgccgcccgctttcacgggtgaggaactctccttgcgccagacgtaaggcgcacatcaacagcttaagctgcccacgcgataaggtatcttccaccggcgcaccgtcggcgcgaatgcgtaagtccgctttgtgcgggccgtgcgcggtgtaggttagctggcgatcgcgttcaaaattacgttccagcacctcagcatattctgtctctttctcccagccgcgctggaaagagaaagtcagagaaaactcagggagaaattgcttacaggtatcagccatatcggccgcgataccggcgctatactccgcgcgccaggtgctgatttgctccgccagcgggatcagctctttatcccacgggcgtagctgttcgtaacgtgtcacctggcgcagcgccgcattgcgctgcttgagcaatcgcttgagattgctccaggcggtgaaaaatccgggttcgttgtgaaagcatccccagtcgaggaatgctcttctgtatttggggccgccgttgagtaaagtaaacccttctggcgttatcaactgcattggcatcaggtgcgccagttccgcgaccttatgcccgtctgtaccgtcgatgcggactttgctgtcgccctgtttgtctttggttaagccaatcgctgtctcgcgctcttcgccctgtaatcgcccgtggagaacaaacgcctcctgctcatggcgaatgacgcgaccaatctgcaaactgcgaaacgcccgaccatggccgagcgtatagatggcttccagcacgctggttttgccactgccgttggcacctaccagaaagttaaagccgggagataaggcgagatccgcggtttcaatgttgcggaaatcgcggatcaacaagcgggtgagggacattacagtctcattggcatgacaacataagccgcgctctggctggccgcatcttcaatctgcacgctggaaaccgaatcggtcagcatcatgcggacgttttcgcatttcagcgcgttcagaacatccagcacataactgacgttgaagccgatttccatctccgcaccgctataggtaacgtcgaggatctcttccgcttcttcctgttccgggttgttggcggtgattttcagctggttttcgctgacataaagacgtacgccgcggaatttctcgttagagagaatcgccgcgcgagcaaacgcctgcttgagcagatcgcagccagcttccagatgtttgtccgggttcttcggcagaacgcggcgataatccgggaagcgaccatccaccagtttggaggtgaagataaagtcgccaacgtgggcgcgaatgttgttgctgccaatctgtacgcgcagcggattgtcgccgccgtcgagcatacgcatcagttcaatcacgcctttacgcggtacgatcaccgaatggcttggcaaagattgaccaattggcattgaacagaccgccagacggtggccgtcggttgccacggtgcgcagttcttcaccttcggtttcaaacagcataccatttaagtaatagcgaacgtcctgatgcgccatagaaaactgggtcgcttcaatcagacgcttcatcgttgcctgcggcagggtaaattcgacttcactctgccagtcatcgaggttcgggaaatccgccgctggcagggtagacagcgaaaaacggctacgcccggagcgtaccagcatccgttcaccttccagctgcacggcaatttccgcgccttcaggcagaccacggcagatatcaaagaatttgcgcgccggaacggtcgtcgctcctggctcgtgtggctgaaccagcgcaacacgtgccaccatttccatctcgagatcagtaccggtcagcgacaacgtaccgtcagcaacctgtaacagcagattaccgagaatcggtagcgtaggacgaccacctaacggaccgctcacctgttgtagcggttttaataaatgctcacgttctacggtaaatttcataggtttacgatgacaatgttctgattaaatttgaaaaatcttctttgatatcgtggctctcttcacgcaactgctcgatcttacggcaggcatgaagcaccgtcgtgtggtcacggccaccaaacgcatcgccaatctccggcagactgtggttagtcagctctttcgccagcgccatcgccatctggcgcggacgcgccaccgagcgggatcgacgcttggaaaggagatccgcgactttgatcttgtagtactccgccaccgtcttctgaatattgtcgatggtgaccagtttttcctgcaatgccagcaagtcgcgcagcgcctcacgcacgaagtcgatggtgatcgcccgtccggtaaagttggcattggcaatgacgcggttcagcgccccttccagctcacgtacgttagatcgtagacgcttggcgataaagaacgccacttcgcccggcaaacgaatgtcgttttcgtcggcctttttcatcaggatcgccacacgggtttccagctctggcggttcgatcgccacagtcagtccccaaccgaagcgggatttcaaacgatcctcaacgccgttgatctctttcggatagcgatccgaggtgagaatgatctgttgattaccttccagcagggcgttgaaggtgtggaaaaactcttcctgagatcgttctttattagcaaaaaactgaatatcgtcgatcagcagtgcatctacggaacggtagtagcgtttaaactcttcgatcgcgttgttttgcagggctttaaccatgtcctgaacaaagcgctcggagtgcatataaaccactttggcattcggcttgcgcgccataatgccgttacccaccgcatgcagcaggtgagttttacccagacccgtgccgccataaaggaacaacgggttataggcaccgccagggttatccgccacctggcgagccgccgcgcgcgccagttggttagatttaccttcaacgaagttatcaaacgtgtgtttgacgtttacgttagaacgataggtcggttctgccggggccgggacgttatcccaacctgagcgcgtagaaggcgcagcacgttgcggctgcgtttgcgccacctgtgcaggggccgcgacgttgctcgtcactgccgcttgtggcgtttgcgtcaccggtttggtgccgacttcaaaacgcagctgtggggcatccgctccgcagaaactggttagcagtccattgatattattaaggtacttgtcccgtacccaatcgaggacaaaacggtttggcgcgtacagggccagcgtgttatcgctcagttccgcctgcaatgggcgtatccacatactgaattctgtggctggtaactcatcctgcaatcgggcaagacactgctgccaaagcgaaagtgacacggcggactccactcgaacaaaagtcgataatgactaaggctgaaacattcatgattgttgacgtacgtcgaaaagaccctgcttgagggtgacgcacgaaccgctgtctgcggttatatgcccgatcaagatcctgcaaaacgatcgggaccgcggatcatagcctaaactgcgcaagagatcttctgtttctcacagattttcccgatttatccacaggactttccagaactcgctaagtgtaaacgatcctgccgcgaggcgggcacgatttacgccgcatattggaaaatttaatgaccatagacaaaaattggcttaatcgatctaataaagatccaggacgatccttgcgctttacccatcagcccgtataatcctccacccggcgcgccatgctggtttccactggtgtgaggtcgtacattttccctgcgaaaaggtgcggaaaagcgcggtaaataaggaaagagaattgactccggagtgtacaattattacaatccggcctctttaatcacccatggcttcggtgtccatcgtttcatttttcggcggatatccaataaagccattgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaataaagctaacccctgagtggttaagctcgcatttcccagggagttacgcttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctgatagccctcattcgggtctatcaacgcctgattagtccgctactcgggccgcattgtcgtttcactccaacctgttcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaacgatggattcgcaacgcaatcttttagtcatcgctttgctgttcgtgtctttcatgatctggcaagcctgggagcaggataaaaacccgcaacctcaggcccaacagaccacgcagacaacgaccaccgcagcgggtagcgccgccgaccagggcgtaccggccagtggccaggggaaactgatctcggttaagaccgacgtgcttgatctgaccatcaacacccgtggtggtgatgttgagcaagctctgctgcctgcttacccgaaagagctgaactctacccagccgttccagctgttggaaacttcaccgcagtttatttatcaggcacagagcggtctgaccggtcgtgatggcccggataacccggctaacggcccgcgtccgctgtataacgttgaaaaagacgcttatgtgctggctgaaggtcaaaacgaactgcaggtgccgatgacgtataccgacgcggcaggcaacacgtttaccaaaacgtttgtcctgaaacgtggtgattacgctgtcaacgtcaactacaacgtgcagaacgctggcgagaaaccgctggaaatctcctcgtttggtcagttgaagcaatccatcactctgccaccgcatctcgataccggaagcagcaacttcgcactgcacaccttccgtggcgcggcgtactccacgcctgacgagaagtatgagaaatacaagttcgataccattgccgataacgaaaacctgaacatctcttcgaaaggtggttgggtggcgatgctgcaacagtatttcgcgacggcgtggatcccgcataacgacggtaccaacaacttctataccgctaatctgggtaacggcatcgccgctatcggctataaatctcagccggtactggttcagcctggtcagactggcgcgatgaacagcaccctgtgggttggcccggaaatccaggacaaaatggcagctgttgctccgcacctggatctgaccgttgattacggttggttgtggttcatctctcagccgctgttcaaactgctgaaatggatccatagctttgtgggtaactggggcttctccattatcatcatcacctttatcgttcgtggcatcatgtacccgctgaccaaagcgcagtacacctccatggcgaagatgcgtatgttgcagccgaagattcaggcaatgcgtgagcgtctgggcgatgacaaacagcgtatcagccaggaaatgatggcgctgtacaaagctgagaaggttaacccgctgggcggctgcttcccgctgctgatccagatgccaatcttcctggcgttgtactacatgctgatgggttccgttgaactgcgtcaggcaccgtttgcactgtggatccacgacctgtcggcacaggacccgtactacatcctgccgatcctgatgggcgtaacgatgttcttcattcagaagatgtcgccgaccacagtgaccgacccgatgcagcagaagatcatgacctttatgccggtcatcttcaccgtgttcttcctgtggttcccgtcaggtctggtgctgtactatatcgtcagcaacctggtaaccattattcagcagcagctgatttaccgtggtctggaaaaacgtggcctgcatagccgcgagaagaaaaaatcctgattcggtgagttttcgctaaaataagggcggtcagttgaccgccttttttcttttcgtagggcggataagcaccgcgcatccgccacacaaagcaacaggaacatcatgagcgataatgacactatcgtagcccaggccacgcctccgggacgtggcggcgttggcatcctgcgcatctccggcttcaaagcccgtgaagttgccgaaaccgtgctgggtaaactgcctaagccgcgctacgccgattatcttccgtttaaagacgccgacggcagcgtgctcgatcaggggattgcgctatggttccctggcccgaactcgttcaccggcgaagatgtgctggaactgcaaggtcatggcggtccggtgatcctcgacctgctgttaaaacgcattctgaccattcccggcctgcggattgctcgccctggtgagttttccgaacgcgcgtttcttaacgataaacttgacttagcccaggccgaggcgattgccgatcttatcgacgccagttcggaacaggcggcccgttcggcacttaactcgctgcaaggcgcattctccgcacgggttaatcatctggtagaagccctcacccacttgcgcatttacgtcgaagcggcaattgatttccccgatgaagagatcgatttcctctccgacggaaaaattgaagcccagctcaatgacgttattgccgatcttgatgcagtgcgtgctgaagcacgtcagggtagtttgttgcgcgaagggatgaaagtggtgattgccggacgtcctaacgccggtaaatcgagcctgttaaacgcgctggcggggcgtgaagcggcaatcgtaaccgatatcgccggaactacgcgtgacgtgctgcgtgagcatatccacattgacggaatgccgctgcatatcatcgataccgccgggctacgtgaagccagtgacgaagtagaacgtattggtatcgagcgcgcgtggcaggaaattgaacaggccgaccgcgtgctgtttatggtcgatggcaccacaacagacgccgtggatccggcagagatctggccggaatttattgcccgtctgccagcgaaactgccgatcaccgtggtgcgcaataaagccgatatcaccggcgaaacgctgggaatgagtgaagtgaacggtcacgcgttaattcgtctctcggcaaggactggtgaaggcgtggacgtgctgcgtaaccatctcaaacagagcatgggctttgacaccaacatggaaggcggcttcctggcgcgtcgtcgccacctacaggcgctggaacaggcagcggaacatctacaacagggcaaagcgcaactgttgggagcctgggcaggtgaactgctggcggaagagttgcgtctggcacagcagaacttaagcgaaatcaccggggaatttacttcagacgacctgctggggcggattttctccagcttctgtattggtaagtaaccgcgcttacgaagccgcattctgactgtcagatgcggcttcgcttcattgttaccactcctgttattcctcaaccctttttttaaacattaaaattcttacgtaatttataatctttaaaaaaagcatttaatattgctccccgaacgattgtgattcgattcacatttaaacaatttcagaatagacaaaaactctgagtgtaataatgtagcctcgtgtcttgcgaggataagtgcattatgaatatcttacatatatgtgtgacctcaaaatggttcaatattgacaacaaaattgtcgatcaccgcccttgatttgcccttctgtagccatcaccagagccaaaccgattagattcaatgtgatctatttgtttgctatatcttaattttgccttttgcaaaggtcatctctcgtttatttacttgttttagtaaatgatggtgcttgcatatatatctggcgaattaatcggtatagcagatgtaatattcacagggatcactgtaattaaaataaatgaaggattatgtaatggaaaactttaaacatctccctgaaccgttccgcattcgtgttattgagccagtaaaacgtaccactcgcgcttatcgtgaagaggcaattattaaatccggtatgaacccgttcctgctggatagcgaagatgtttttatcgatttactgaccgacagcggcaccggggcggtgacgcagagcatgcaggctgcgatgatgcgcggcgacgaagcctacagcggcagtcgtagctactatgcgttagccgagtcagtgaaaaatatctttggttatcaatacaccattccgactcaccagggccgtggcgcagagcaaatctatattccggtactgattaaaaaacgcgagcaggaaaaaggcctggatcgcagcaaaatggtggcgttctctaactatttctttgataccacgcagggccatagccagatcaacggctgtaccgtgcgtaacgtctatatcaaagaagccttcgatacgggcgtgcgttacgactttaaaggcaactttgaccttgagggattagaacgcggtattgaagaagttggtccgaataacgtgccgtatatcgttgcaaccatcaccagtaactctgcaggtggtcagccggtttcactggcaaacttaaaagcgatgtacagcatcgcgaagaaatacgatattccggtggtaatggactccgcgcgctttgctgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcggcctgctgtgcatgaaagacgacagcttctttgatgtgtacaccgagtgcagaaccctttgcgtggtgcaggaaggcttcccgacatatggcggcctggaaggcggcgcgatggagcgtctggcggtaggtctgtatgacggcatgaatctcgactggctggcttatcgtatcgcgcaggtacagtatctggtcgatggtctggaagagattggcgttgtctgccagcaggcgggcggtcacgcggcattcgttgatgccggtaaactgttgccgcatatcccggcagaccagttcccggcacaggcgctggcctgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaaggattaacctttacgtacgaaccgaaagtattgcgtcacttcaccgcaaaacttaaagaagtttaattaatactacagagtggctataaggatgttagccactctcttaccctacatcctcaataacaaaaatagccttcctctaaaggtggcatcatgactgatcaagctgaaaaaaagcactctgcattttggggtgttatggttatagcaggtacagtaattggtggaggtatgtttgctttacctgttgatcttgccggtgcctggtttttctggggtgcctttatccttatcattgcctggttttcaatgcttcattccgggttattgttattagaagcaaatttaaattatcccgtcggctccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggttatcacgctaatccacgtattgtcgggatctgcacagccattttcgttgccagcgtattgtggttaagttcgttagccgccagtcgtattacctcattgttcctcgggctgaagattatctcctttgtgatcgtgtttggttcttttttcttccaggtcgattactccattctgcgcgacgccaccagctccactgcgggaacgtcttacttcccgtatatctttatggctttgccggtgtgtctggcgtcatttggtttccacggcaatattcccagcctgattatttgctatggaaaacgcaaagataagttaatcaaaagcgtggtatttggttcgctgctggcgctggtgatttatctcttctggctctattgcaccatggggaatattccgcgagaaagctttaaggcgattatctcctcaggcggcaacgttgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtgattttgtgctggttcggcaacgtctttaacgtgttacctaaatttggctaaatccttcaagaagccagccattcgctggcttcttgcctctcaggaaatcacttatgtccaaatggcaactcgcctgatcctccttcaccacgtatgctttgcgtcaccttactatcaggacgctttagcccatgtcccgctttttgatttgtagttttgccctggttttactttatcccgccgggattgatatgtacctcgttggtttaccgcgcatcgccgccgatctcaatgccagcgaagcgcagttgcatattgcgttctccgtatatctggcggggatggcagctgcgatgttatttgccggtaaagtggccgatcgttcagggagaaagccggtcgccatacccggcgcggcgctatttattattgcctcggtgttctgttcactggctgaaaccagcacgttatttcttgcaggccgatttctacaggggttgggcgcaggctgttgttacgtagtggcgttcgctattttgcgcgacacgctggatgatcgacgtcgggctaaagtgctgtcattactcaacggtattacctgcatcattccggtgttagcgccagtgctcggacatctgattatgcttaaattcccgtggcagagtctgttctgggcgatggcaatgatgggcatcgcggtactgatgttgtctttgtttattttaaaagaaacgcgcccagcggcccccgcagcttcggataaaccacgagaaaatagcgagtcgctgcttaaccgttttttcctcagccgtgttgttatcaccaccctcagcgtttcggtgatcctcactttcgtcaacacgtcaccggtattgctgatggaaatcatggggtttgagcgcggtgaatacgccaccattatggcgctgaccgctggcgtcagcatgaccgtttcattctccacgccatttgcgctgggaatttttaagccacgtacgttgatgatcacctcgcaggtgttattcctggcggcggggatcactcttgccgtttcaccttcccatgcggtttctctgtttggtatcacgctgatttgcgccggtttctcggtaggttttggtgtggcgatgagtcaggcgttagggccgttttcattacgcgcgggcgtagccagctcgaccttaggtattgcgcaggtttgcggttcgtcactgtggatttggctggcagcggtggttggtatcggcgcatggaatatgctgatcgggattctgattgcctgtagcatagtgagcctgttgctgattatgttcgtcgcgcctggacgccccgttgccgctcatgaagaaatccatcaccacgcttgatctcaatctgctgctttgtctgcaactgctgatgcaggagcgcagcgtaaccaaagcggcgaagcggataaacgtgacaccttcggcggtgagtaagtcgctggcaaagttaagagcgtggtttgacgacccgctctttgtgaactcaccgctgggtctgtcgcccacaccgctgatggtcagcatggagcaaaatctggcggagtggatgcaaatgagcaacctgctgctggataaaccgcaccaccagacaccgcgcggcctgaagtttgagctggcggcggaatcaccgctgatgatgatcatgcttaatgcgctgtcgaaacagatctaccaacgttacccgcaggcgaccatcaaattacgtaactgggattacgattccttagatgccattactcgtggtgaagtggatatcggtttttccggtcgcgaaagccatcctcgctcgcgggagctgttaagctcgctaccgttagccattgattatgaagtgctgtttagtgatgtgccctgcgtctggttacgcaaagatcatccggcactgcatcaaacgtggaatctggacaccttcttacgttatccgcatatcagcatttgctgggaacagagcgatacctgggcgctggacaatgtgttacaggagctgggacgcgaacgcacgattgctatgagcctgccggaattcgagcagtcactgtttatggcagcgcaacccgacaatctgctactggcgaccgcgccgcgctactgtcagtactacaatcaactccatcaactgccgttggttgctcttcctctcccgtttgacgaaagccagcaaaaaaagctggaagttccttttaccctgctgtggcataaacggaacagccataatccgaagatcgtctggttacgggaaaccattaaaaacctttacgcgtcgatggcataaccgaatcgtatgaaacgcgacccaatttcacaataaaatgtaaaaaagttgtaataagcttgtctgaatcgaacttttagccgctttagtctgtccatcattccagtaaatgattactcttgtattcataatggaccattaagcatggagcgaaaaatggcgactcactttgcccgagggattttaacggaaggacatctgatttctgttcgtctcccctcccagtgtcatcaagaagcccgaaacattccccctcatcgtcaaagccgttttctggcgtccagaggtttactcgcagaactgatgttcatgctgtatggcattggcgaattgccggaaatcgtcaccctgccgaaaggtaaaccggttttcagtgataaaaatttgccttcgttttccatttcctatgccgggaatatggttggcgtggcgttaacaaccgaaggtgaatgtggcctcgatatggaactacagcgtgcgacgcgcgggtttcatagcccacacgcgcccgataaccacaccttttccagcaatgaatcgctatggatcagtaaacaaaacgatcctaacgaagcgcgggcgcagctcatcacgctgcgccgaagcgtgctaaaactaaccggtgatgttttgaatgacgatccgcgcgatctgcagctgctgcccattgccggacgcctgaaatgtgctcatgtaaatcatgtagaagcgttatgcgacgcggaagacgtgctggtgtggtccgtggcggtcacgcccacgattgaaaagctcagtgtctgggagttagatggcaaacacggctggaaaagcctgccggatattcacagccgcgccaacaatcctaccagccggatgatgcgttttgcccaactctctaccgtgaaggctttttcgccaaattgatagacaaccacaggagtcatcatgtctgaaaaattgcaggtggttacgttactggggagcctgcgcaaaggctcatttaatggcatggttgcacgtaccctgccgaaaattgctccggcgagcatggaagtcaatgcgttaccatccattgccgacattcccttgtatgacgctgacgtacagcaggaagaaggttttccagcaacggttgaagctctggcggaacagatccgtcaggctgacggtgtggtgatcgtcacgccggaatataactactcggtaccgggtgggctgaaaaatgccatcgactggctttcccgcctgccggatcaaccgctggccggtaaaccggtattgattcagaccagctcaatgggcgtgattggcggcgcgcgctgtcagtatcacctgcgccagattctggttttcctcgatgcaatggtgatgaacaagccggaatttatgggcggcgtgattcagaacaaagttgatccgcaaaccggagaagtgattgatcagggtacgctggaccacctgaccgggcaattgaccgcatttggtgagtttattcagcgagttaagatctaaataaaaaacccgccagcaatcatgcatggcgggtttttaacgcgctatcgattttagtgagcgtcgataaagacaatcttcaggataaacagcagcgcaacgatgattacgcacgggcttagatcacgcagacgtccggtaccgattttcatcacgcagtaggagataaagcccagcgcgataccttcggtaatcgagaagctgaacggcatcatcacggcggtaataaacgccggaacagattcagtaagatcctgccagttcacgcgtgccagactggaagtcatcagcacgccaacgtaaatcagcgcaccagctgcagcgtagcctggcaccatccccgccagcggcgacagaaagataaccagcaggaacagcagaccaacaaccactgccgtcagaccggtacgaccgccaaccgatacgccggaagaggactcaatataagccgtaacggaagaagtaccgataaacgaaccggtcacggaagagatactgtcgacatacagcgcctgcttcatgcgcgggaatttccccttctcatccgccagacctgctttatcggtcacgccaatcagcgtaccggaggagtcaaacaagttgaccaacatgaaagagaaaatcacccctgccagcccgaggttaaacgacccggctaaatctacatgacccacaactgtcattacgctcggcggcgcagaaacgatgccattgtagtgcacatcacccagcatccagcccagcagcgtcgtcaccacgatagaaaccagcaccgctgcgtgaatgttgcgcgaggccagaatagcaatgatgaagaagccgaggatacccagaagtacgctgtgagaagtcagattaccgatgctcaccagcgtttccgggttagcgacaatcacacctgcgtttttcagccccatcatgccaatgaacagaccgataccgctggtaatacccacacgcagactcaccggaatgttggctatcatccagtagcgaacgcggaaaatcgtcagtaacagcagacctatcgcgccccagaagattgcgcccatcccgacctgccacggcaagcccatcgcctgtacaacgacaaaagcgaagaacgcattcaggcccatagcgggtgccagtgcaactggcaggttagcaaacagtcccatcataatactgccgaatgcagcgatcagacaggtagtgacgaagacggcgctggtatccatgccagcaacgccaagaatttgcgggttaacaaaaacgatgtaaaccatcgtcaggaaggtggtaaaaccggcgatcacttcggtccgtgccgtcgtgccatgttcgcgcagtttaaacacgcgttccagcatcccctgaccagaagtctgggtggtatgttgatgactcattatctatttccgaacaaggagggaaaatccgtcgctatcgtataccaaaatgcgacaataggcgcgtttgtgagagacttttttattggatttacttatacggcaacgattgcgttgcgcaaatcggctctacgaaaacgttaaactgattaaaaaggaaaggcatgtcccggatagaagcggtatttttcgactgcgacggtacgctggtcgacagtgaagtcatttgctctcgcgcatatgtaacgatgtttcaggaatttggtattacgctcgatcctgaagaggtattcaaacgtttcaaaggtgtaaaactgtacgaaattatcgatattgtttcccttgaacatggtgttacgttagcgaaaacagaagctgaacacgtttaccgtgcagaagtcgctcggctgttcgattcagaactggaagccatcgaaggggctggagcgctcctgtcagcgatcactgcgccaatgtgtgtggtatctaacggcccaaataacaaaatgcagcattctatgggcaagctgaatatgttgcactacttcccggataaactgttcagcggctacgatattcagcgctggaagccagacccggcgttaatgttccatgcggcaaaagcgatgaatgtaaatgtagaaaactgcattctggttgatgactcagttgccggtgcacaatctggtatcgacgcaggtatggaagtgttctacttctgcgccgacccgcacaataagccgatcgttcacccgaaagtcaccacctttacccatctttcgcagttacctgaactgtggaaagcgcgtggttgggatattacggcatagttcttcacactcccttcacttaccccgcttaaattggcgctcaaaggtaagtaaagggagtttgatatgtctgtttcacgtcgggtaatacatcacggactttattttgcagttttaggaccgttaattggtgttctgtttcttgtcctctacatattcttcgcaaaagaaccgctggttctttgggtgataatacatccaatttttctcttattgtcgataactacgggagctattcctgcgttgttaaccggtgtaatggttgcctgtctgccggaaaagatcgggtcacagaaacgttatcgttgtctggctggtggcataggtggcgtcgttatcaccgagatctattgtgcagttattgtacatattaagggcatggcttcctcggagttgtttgaaaacattctttctggtgacagtctcgttgtccgcatcattcctgcattgctggcaggtgtggtgatgagcagaatcattacccgtctacccggattggatatttcatgtcctgaaacagactctttaagttaagcgggatactttatctttgggctactcaaaagcagacaggatgtttctatgactcaaaatatcaggccgttaccccaattcaaatatcatcccaagccactggaaacaggcgcatttgaacaggataaaaccgtagagtgcgattgctgtgaacaacagacgtcagtttattactcgggtcccttttattgcgttgatgaagttgaacatctctgtccgtggtgtattgcggacggttctgctgctgaaaagtttgcaggtagttttcaggatgatgccagcatagaaggtgttgaatttgagtatgatgaagaggacgaatttgccggtattaagaacacatatcctgatgaaatgctgaaagagttggttgaacgcacgccaggttatcatggatggcagcaggaattctggctcgcgcattgtggcgatttctgtgtttttatcggctatgtgggctggaatgatataaaagatcgcctcgatgaatttgccaaccttgaagaagattgtgagaatttcggtattagaaattctgatctagctaaatgcctgcaaaagggtggtcattgtcagggttatctcttccgctgtctccactgcggcaagctgagactgtggggtgatttttcgtagttatttaaataatgagaacaggccggagcgtaattcacacatccggccttatttcttaagcttaaccgagtgctaattctgcggcagcggctttatcagcgattaccatcagcgaaggatgcagctgcaacacggaagctggaacatcttcggtaaccggaccttgcagaacatttttcagtgcctgcgctttacccgcgccgctgacaattatcagcaagtttttcgccgccatgatgcttttcggccccatcgtcacgtagctgtcaggcactaacgaaaagtcgccgcccaactcgccatgcgccacaatatcaaccatctctccctggatcgggaactccacggtttgctcatggaaatgggtcgtattcggcaaattgccacaaaaatgaccatctgcacctaatcccagcaccaccaaatccagtccgccttcacgcgccagtttctgatcatgctcgcggtagttatcaatagtgagcttctggatattctcttctttgatccccgcaggggtgaaaaacagattacgcagattggtaatcgttacgccttctccctctttgccgcgaaatggaatttcatcaaaattatagaaatagcagttatcgtaccagggcttacctttaaccagggtggtgaggtattcatacatgcctttgggcgtgctaccggcggtaattgccaggttaacacgacgcgtcttcgacatataaccaagcagatggtgtgccgcgacacggctcatttcctggtaatcttcggtaatgattaatttcatcttaatgccttattttatttaaataatttctgtacaaaggctgcataggctggtcgccagacatccatttcatggttcagacccggatattcctggtaatcaaagttaatttttttctgctcaagctcagttttcagcccggcgatatccttgccggttacgacatctttatcccccacaaccacagtaaaattacgtagttgctggttgatagctgccggatcgttcagtcgggccgcgacaccttcatccggtacggttgtcgtggtaacaccactgaatgtggccagccagccaaagctttccagatgattcattccggaaaccagcgcctggtacccgccttgtgaaagccctgccagcgcgcggccatcggcatctttacggacattaaaacgcttgctaatcagcgggataatatcgttcatcagttcgcgatctgccgctttagcattcagcggataaaagactttacgtctttcctgaggcacgaaatcttcgggaataatgcccttcgcatcggtttctgtatccgggatcaccaccagcatcggtttaattttcccttcagcaagcaggttatccatgatttgcgggatacgcccctgatcgatagcggaacgtccggtatcaccaaagccgtgatagaaatagagcactggcaaaggctcgcccatgccggtgtatcctggcggggtccagacatacatctgacgttcagattgcaatgcgttggagtggtaagttatggcgatcaaatcaccatgcgcaacagaacgcgtatccagataactgcctggcaccagaatcatactggagttaacctggcgctgaggattagtcattgcggtgcctgtatcaatgctgcgtacaccatcaacattgaaaaaatactcgtacaggttgcctttcaggataggtgtgcgccacgaccagactcctgcttcgtctttggtcatcgggtgaatattgtccggaaccggaacacccaccactacagagacattttttgccccaggggcaaagtagcgaaaggtcacgctgttatcggcattgacctgagtcacatactgtttcaccgggatagtgggtgccgggctggctggcatatccgctgctatggcccactgagcagaaataccgctggcaatagccagcgttaaagcagcaatttttatattcatcgtaatattcctttcattaagttccattaccaccagatttcagcctgggcaccgacagcaaactggtcgtctttattgtcttcaaaggtgaagccatccagttcgttttccagggctttgatatacgtggcgtagaaacgaatttccggacgcgaggtcaacatactggtattgactttaaaggtatggaagagcgtggttttataaccagactcattaaatttattactattcgcatctttgttttgctgggtgaaatagcccagttcaacacctgtctggttatattggtcccaaatataggccgggcgaacaaccgcacgaatagattcgaaatcagagtgggcgcctgtttcgtagctatatatatcgttaccgaaggagtaaacaatcgcgttagctacaatgaaatgatcgccaatataggcttcgccctgcgaagtcagacgtaccgctgttccgccggtgtgatcaccataataacgaccattaaaggtggtaaatggacttgcgccagcataacggccaaagttactggcgatagagttattcgcgaccaggaaggagaattcgttgaagccacctttatcaaatttctgcgttaaagatgtgccaaacatccaggtatctttccagtcataatacccgttattatcctgattatctttttccgatgcgctttcgtttgccgtgacataacgaccacttaccattaaggtggctttatcccataacgggatatctttatagcgtaaatcaatggtattggtattaatctgctgtttgttttgcaggctgcgatcgtaatcatcgacatcttcgcgaaccagcgcgatatcaattttacccggaccgactttccagttttccagacctacacccgctgcggcatcagtacgctgcgttttccagtcaagcatctggatttcaattttcggcgcaccgtgtttacccacccagaaatcagcctctggcgcaaagggcaggaaacctttggtggtaacgtacatatcggagaactgcatatagttctcgccaccggcgttatcgccaaaccagccggtagagtactgctgaccaacgttaccatccatcatcacaacggcatcaacccgtttgccgttttcgttgtagacacgttgttttaactgcaaatcaaaccagccggagtattcgttaccaaagcggcccagagaaccaatcgcccatgatttaggtgaaccatgagaggcggtcccccaaccagaacggtaatagccgttgtaactaaagccaatttcatctttcacaaatttactgaaatctttcagagtcatggaagaataaatcgagcctgtctcactggcatttttctcttcatttttgaccagtacagcatcaggttttgcggcactactggtcgggaacggattggcggcatacccttgatcattcgtacttacgctacgattcaccgtcgctggcgtatactttttcttctcttcatctttatactttttgagttcgctttgcgtttctcttaacgccttttctaataactcaaggcgttgttccaccgttaatgattcagccaatgattgtgcagaaaaggctaacggtgccattaataagatggcagaggtaataagatttcgtctaaacataatatccctttatggtgcaaagaaagaattaacgcatcgcatccagactgttctgaatgcgacgataattaaggtgctttaatggttattttttttaatgacagcccccgcgtcttgatcacctctgcataccatccgaagcttttcttgcgtgttcttgtgaggcttccttcgccattatcatcacgatccacataaataaagccgtagcgcttagacatttgtgaatgagatgcactgactaaatcaattggcccccaactggtgtaccccataatatccacaccatcggcaatcgcttcatttacctgtaccaggtgatcgtttaaataggcaattcgataatcgtcctgtatcgaaccatccgcttcaacgctgtcttttgcgcctaatccgttctcgacaataaataacggtttttgataacgatcccaaagcgtatttaacagaacccgtaatccaaccggatcaatttgccacccccactctgaacttttcagatgcggattggggatcatattcagtatgttgccctgcgcatttttattaatgctttcgtcgtgggaaacacaaccagtcatgtaataactaaaagagatgaaatcgacggtatgttttaaatcttctgcgtcactttcagtcatctcaatggtgatattgtggtcgcggaagaaacgctgcatatagccgggatactggccacgcgcctgaacatcaccaaagaacatccagcgccggttctcttccatggcctgcaacatatcctgtggctggcaggtgagggggtaaaccagcccaccgagaagcatattgccgattttcgcttcggggagcaggctatgacaggctttaactgcccgcgcactggcaaccagttgatggtggatagcctgataaacttccgcctcgccactctcttctgccagccccacgcccgtgaatggcgcgtgtaacgacatgttgatttcattaaacgtcagccataacgccactttatgttggtagcgagtaaagaccgtgcgggcgtaatgctcgaagtgatcgatgaccgctcgattagcccaaccgccgtagtttttcaccagcccatatggcatttcgtaatgggataacgttaccagcggcttgatccccgcctgcgccatttcatcaaacagccgatcgtaaaacgctaaccccgcttcattcggttcgacttcgtcgccctgagggaaaattcgcgcccaggcaatggaaatacgcagacaggtgaagcccatctcggcaaataacgcgatatcttccgggtaacggtgataaaaatcgatggcgacatctttgatattctctttccccaggatgcgcggttccatttttcccattacgccatgaggctgtaaatctgaggtcgagatccctttgccatcttcctgccaggcaccttccacctgattggcagctgttgcgccaccccaaagaaatgtttctggaaatgctttcataattaactccttttatcgttagcgaatgatggataacagcggttcacctgcgcttatctgcgccgtgccgtggggtaatacgtccgtaaaatcatcgctattactgattaataccggcgtcgtcagatcaaatccggcctcgcgaatagcagggatatcaaaagaaatcagccgatcgcctgtattgaccttgtcacccacgttgacgtgagcggaaaagaatttgccgtccagttttacggtgtcgataccgacatgaatcaggatctccacaccatcatctgactcaatgccaatggcgtgtaatgtggcgaacaacgaagcaattcgacccgcaaccggagaacgcacttcaccaaccgagggcagaatggcaatacctttacccaacaggccactggcaaacgtggtatcagcgacgtgaatgagcggcacaatctctcccgtcatcggtgaacagataccgccctgctcaggtggtgtaataacctctggtgttttctcttgcggggcaccctgcgctggctgacgtttagcggtgatgaaatgaagcatcaccgtaccgacaaatgcgcaaccgatggcaatgacaccgccaataacgctggcccagacggtgaaatcaattcccgttgacgggatggtttgcatgaaggtgaaaatacttggcaaaccaaaggagtagactttcgtttgcgcgtagccaataatggtggcccccaaagccccactgatacaggcgataacaaaggggtacttacgcggcaggttgacgccatataccgctggttcggtgataccaaacagactcgtcaacgccgctgatcccgccaccacttttttctgcgcatcgcgttcgcagaggaagacgccgagcgccgccccgacctgcgccataatggcgggcattaacagcgggatcatggtgtcgtagcccagcacggtgaagttattgatacacagcggcaccaggccccagtgcagtccgaacatgacgaagatttgccagaagccgcccattaccgcgcccgcaaatgcaggaaccgcctgataaagccagagataaccggcggcaatcagttcgcttatccaggttgatagcggccccaccagcagaaaggtgacgggtgtgataaccatcagacatagcaatggtgtgaagaaatttttgattgccgacggtaaccacgcattaagtcggcgttccagaatgctgcacaaccaggcagaaaaaataatgggaataaccgatgacgagtaattcaacaatgtgaccggaatacccaggaaatccagccccagcgcatccgctttttgcccgttctcgaaagcagtcagaattaatggatgcactaacgctccaccaatcaccatggcagtaaatggattaccgccgaagcgtttccccgcggtgtatcccaggattatcgggaagaaccaaaacaaggcatcactggcgctgaataaaattaaataagtaccactttgttcggtcgtccactgaaaagtgagcgccagagccagcatacctttcaagatcccggttgccgccatcaaaccgatcagaggcgtaaaaatacctgaaataacataaacaaagcggtttagcagattacctttatcatcattttccggtgcctgttgcgctttttcgtcaaggcctgccacactgttaaccgccaggaagacatcggccacatggttacctatgaccacctgaaactggccaccgctttccaccaccataataataccgggggtctttttcagtacctctgcttgcgctttgctttcatcctttaatttaaaacgtaatcgcgttgcgcaatgcatcagactcacaatgttatctgcgcccccgactcctgcgactatttttctggctaactccgtcataacttgccctctaccgctttgcggcaaaactccaaaaaaaaacctgaaaaaaacggcctgacgtgaatcaagcaatttttttcaggttttgcccgcttagtgcggtaacaatcctttactcagtaataatatttcagtgttctttgcgcacgcgctctatatttatggctaaaaacataatctctgcgggtgaaattttacgttgatactgcaaaccaataaaaatggcgatccgttccgcacattgccatgcttgcgggtaattttgttttactgcttgttgtaatgattcatcactatcgttaattgaagcatgttcaagaatacgccaggataaaaacttcagatgtgtaaccagtcgctgataactcaagctttcttcctggtaattaaggctgaactgaaattttattaattgcagcatttcgcgcattaactgcgtgacacctgcaacatcctccatatttccgctcatttgggcactgaccagatgcatggcaataaagcccacttcatctttcggtaactgcacgcccaaccgtttatcaataatggttaacgcttcttcccctagctggaactctttcgggtaaagccgctggatatcccacagcaacgggttgggcagcaacacgttttgctgaaagcgtttaatcgcaaactggcaatggtcagttagcgagatataaatactgtcctgtaattttcccaagcgctcctgcgctaaagagataatacgatcacaggttgccatcacctcaagaggaatatgacttaagagttcgcttaatcgcccgttcagttcatgactgctcaaggcatactctttttctattccacttgagttaattctttcgccagcgcgtttttgaaagccaattccgcgccccatgacgactttttcccgctgttgatcatcaataaccaccacaacattattgttgagaattttggtgatttgcatgttcatagcaaggaccttttttataaacaaaaaaacccgacttcaccagtattctctggttatgtcaggttttgcctgcgaatgcagtaacaatccagtcatttattaatggtttttataacgaacatccaggttcggaaattaatttaattgcgtgcagagaaaatagcaatgcgctattgataaaaatatgaccatgctcgcagttattaactttgtgtaattttaggaatttataaagttatatataacaaatcccaataattaagttattgggatttgtctggtgaattatttgtcgctatctttccccgccagcagtttatccagctcatcgccaccgacgtgacggaaatcctgccccttcacgtagtagaagataaactcacaaatattctggcagcggtcgccaatacgttcgatagaacgcgcgcagaacagcgcagtaagtacgctcggaatggtacgcgaatcttccatcatgtaggtcatcagttgacgaacaataccttcgtattcctgatcgacttttttatcttcacgataaatacgtaccgcttcgtcaatgtccatccgcgcgaacgcgtccagcacgtcgtgcagcatctggatggtatgacggcccagcgactccagacttaccagcaacggctgatgctgctgggagaatttctccagcgcagtacggcagattttgtccgccacgtcgccaatacgctccagctcggcaatggttttactgatcaccataaccagtcgcaggtcgctcgccgtcggctgacgtttggcgataatgcgcacgcaggcttcatcgatcgccacttccatcatgttgacgttcttgtcgccttcgatgacgcgcttcgccagatcgctgtcctggttatgcatcgcggtgattgcatcagaaagctgctgctccaccatgccgcccatggtcatcacctgcgtgcggatactttccagttcggcgttgaactggccggaaatatgtttattaagattgagactgtccataacgcactcctgaatcaaccgtaacgaccggtgatgtagtcttctgtttgtttcttcgctggcttggtgaacagatcgtccgtgttgctgaactcaatcaattcgcccaggtacataaacgccgtgtggtcggaacaacgcgcagcctgctgcatgttgtgggtgacgatcaccacggtgtaatcctgcttcagttcggtgatcagctcttcaatacgcccggtagagatagggtcgagcgccgaacacggttcgtcgagcagcagcacttccgggcgaatggcgataccacgcgcaatacacagacgctgttgctgaccaccagagagagagtaaccgctctggtgcaatttatctttggtttcgttccacaatgcggctttggtcaatgcccactgcacgcgctcgtccatgtcggcacgggagagcttctcaaacagacgaacgccaaaagcgatgttgtcgtagatggacatcggaaacggcgtcggtttctggaacaccatgcccactttcgcacgcagcagtgcgatatcctgagagttggtcaggatgttgtcgccatcaagcagaatttcaccttccgcacgctgctccgggtacagttcaaacattttgttgaaggtacgcagcagcgtcgatttaccgcagccggacggcccgataaacgccgttacctggtttttagcgatatccaggttgatgtttttcagggcatggaatttgccgtagtagaagttcaaattacgaacctgaattttactcggggcagtttcaaccatactcattgcaatcttttcctcatcgtgcctgatgcacttcgctaatcaggcttaccgtaggccggatcaggcgttcacgccgcatccggcaaagtgttaaccgtgtacagagtcaaaaaggcgctcggtcggtcccctcgcccctctggggagagggttagggtgaggggaaaaccgtgtcagcaatatcaaccgtgtttattcttcgcaaaaacaacgcgcgccagaatgttcagcagcagtacgcacagggtaatgatcaataccccggcccaggccaattgctgccattccgcaaacgggctcatcgcaaacttaaagatcgtcaccggcaggttggcgatcggctgcatcatgtccgtgctccagaactggttggagagcgcggtaaacagcagcggcgcggtttcaccagcaatacgggcaatcgccagcaggataccggtcataatcccggacaccgacgctttcagcgtaatcgcagagatcatcttccacttcggtgtacccagcgcataagccgcttcacgcaggctgtacggcaccagtttcagcatgttctcggtggtgcggataacaatcggcacctgcaacaacgccagggcaatcacgcccgcccagccggagaagtgctccatctgcgccaccacaatggtgtaaacaaacagaccaaccacaatcgacggcgcagagagcagaatgtcgttaatgaagcgaatcacttctgccagccaggatttacgaccatattccgccagataaatccccgccataatgcccagcggcgtaccgaataccgtggcccacaaaattaacagcccgctacccgccagagcgttcgccagaccaccaccttccgtattgggcggcggcgtcatttcagtgaacagcgccagcgacataccgtcgataccgcgagtgatggtggacattaaaatccagatcagccagaacaggccgaaggccatcgtcgccatcgagagcgtcagcgcaatacggtttttgaggcggcgacgcgcctgcattttgcggcgagattcagccagcgccgcagtggtttgcatttcaaccatagccattagcgtgccccctcattcttagccaggcgcataatcataaacttcgatgcggcgaggacgatgaaggtaatcacaaacaggatcaggcccagttccatcagtgcggcaacgtgcagaccggattccgcttccgcaaattcgttcgccagcgcagaggtgatactgttgcccggcatatacagcgaggcgctgtcgagctggtaggtgttaccgatgataaaggtcaccgccatggtttcaccgagcgcgcggcccagccccagcatgatgccgccgataacaccatttttggtgaacggaagaacgatacgccagataacttcccaggtggtgcagccaataccgtaggccgactctttcatcatcaccggggtttgttcgaacacatcacgcattaccgccgcaatgtacggaataatcatgatggcgaggatcacgcctgccgcgaggataccgataccaaatgcggggccagagaacagcgcgccaacaatcgggatattcgacatgatattgccgaccggctcctgaaagtaaacggcgaacagcggcgcaaagataaacaggccccacatgccgtaaacgatacttggaatggctgccagcagctcaatggcgatacccagcgggcgtttcagccagccaggcgcaagctcagtcaggaacagggcgataccgaaactcaccgggacggcgatcagcagcgcgataaacgaagtcaccaacgtaccgtagatcggcaccagcgccccgtagatatcgttcggtgcatcccactctttggtccataggaaagccagaccaaatttctgaatgctcggccaggaggagatgatcagagagacaataatgccacccaacatcaatagcacaatcagcgccgccagttttaccagcacgctgaaaattatgtcgccctttttacccggtgggttaaaagcaggcttggttgcagccataagttactcttcagttaaacgcgtttacaaagtcattttgtaatgccggatgcggcgtaaaacaccgtacccggcctggagttttattagtacagcggcttaccgctactgtctttaatattggtcttccacgcagcgcgaacctgttcaactacactatccggcaggctggcgtaatccaggtcgttcgcctgtttagccccggttttgtacgcccagtcgaagaatttcagcacttctgtgccttgttctggtttcttctgatctttgtggatcagaatgaacgtggtagaggtaataggccatgcatcttcgcctttctggttggtcagatcctgagcgaaggttttgctccagtctgcaccttttgctgcattagcgaagttttcttcggtcggactaaccggtttaccatcagcggagatcagtttggtgtacgccaggttgttctgcttcgcgtaagcatattcaacataaccaattgcacccggcagacgctgaacgaacgcggcgataccgtcgttacctttaccgcccagaccgatcggccattttacggtagagccagtaccaacgttgtttttccactcttcgttcactttcgccaggtagctggtgaagacgaaggaagtcccggagccatctgcgcggcgtactacagcaatgttttgtgaaggcagtttcagacccggattcagtttggcgatggcttcatcatcccacttcttgattttgcccaggtagatgtcgccgagggttttaccatccagcaccagttcgccagacttcagccctggaatgttaaccgccagcaccacgccgccaatcacggtcgggaactggaacagaccttcctgagccagtttttcgtcagacagcggcgcgtcagaggcaccaaaatcaacggtattagcgataatctgttttacgccaccggaagaaccgataccctggtagttaactttattaccggtttctttctggtaagtgtcagcccatttggcatacaccggcgcagggaaggttgcacctgcacctgtcaggcttgcttctgcaaacacagagaaagcactcatcgataaggtcgcggcgacaacagttgcgacggtggtacgcataactttcataatgtctcctgggaggattcataaagcattgtttgttggctacgagaagcaaaataggacaaacaggtgacagttatatgtaaggaatatgacagttttatgacagagagataaagtcttcagtctgatttaaataagcgttgatattcagtcaattacaaacattaataacgaagagatgacagaaaaattttcattctgtgacagagaaaaagtagccgaagatgacggtttgtcacatggagttggcaggatgtttgattaaaaacataacaggaagaaaaatgccccgcttacgcagggcatccatttattactcaaccgtaaccgattttgccaggttacgcggctggtcaacgtcggtgcctttgatcagcgcgacatggtaagccagcagctgcagcggaacggtgtagaagatcggtgcaatcacctcttccacatgcggcatctcgatgatgtgcatgttatcgctacttacaaaacccgcatcctgatcggcgaagacatacaactgaccgccacgcgcgcgaacttcttcaatgttggatttcagtttttccagcaattcgttgttcggtgcaacaacaataaccggcatatcggcatcaattagcgccagcggaccgtgtttcagttcgccagcagcgtaggcttcagcgtgaatgtaagagatctctttcaacttcaatgcgccttccagcgcgattgggtactgatcgccacggcccaggaacagcgcgtgatgtttgtcagagaaatcttctgccagcgcttcaatgcgtttgtcctgagacagcatctgctcaatacggctcggcagcgcctgcagaccatgcacgatgtcatgttcaatggaggcatccagacctttcaggcgagacagcttcgccaccagcatcaacagcacagttaactgagtggtgaatgctttagtggatgccacgccgatttctgtacccgcgttggtcattagcgccagatcggattcgcgcaccagagaagaacccggaacgttacagattgccagtgaaccaaggtaacccagctctttcgacagacgcaggccagccagggtatccgcggtttcgccagactgtgacaaggtgatcatcaggctgttacgacgcacggcagatttgcgatagcggaattcagaggcgatttcgacgtcgcacggaatacctgctagcgattcaaaccagtagcgggaaaccataccggagttataagaagtaccacaggcgaggatctgaatatgctcaaccttcgacagcagttcgtcggcgttcggtcccagctcgcttaaatcaacctgaccgtggctgatgcgtccggtaagggtgtttttgatcgcgttcggctgttcgtagatctctttctgcatgtagtgacggtaaatgcctttatcgcccgcgtcatattgcagattggattcgatatcctgacgttttacttccgcgccagttttatcgaagatgtttaccgaacggcgagtgatttccgcaatatcgccctcttcaaggaagataaagcgacgggtcaccggcaacagcgccagctggtcagaagcgataaagttttcgcccatccccaggccaatcaccagcggactaccagaacgtgccgccagcagggtatccgggtgacgggagtccatgatcactgtaccgtacgcaccacgcagctgcgggatagcacgcagaacggcctcacgcagagtcccgccttgtttcagctcccagttcaccagatgggcaatcacttcggtgtcggtttcagaaacgaaggtatagccacgcgcttttagctcttcacgcagcggttcatggttttcgatgatgccgttatgcaccaccacaatgtgttcagaaacatgcggatgcgcattcacttctgaaggttcaccgtgggtcgcccagcgagtgtgagcaataccagtgccgccatgcagaggatgttcttccgctgcctgtgccagcatctggactttaccgaggcgacgcaggcgggtcatatgaccttctgcatcaacaacggccagaccggcagagtcatatccgcggtattccagacgacgtaaaccttcaagaaggatttctgctacatcacgttgcgcgatcgcgccaacaattccacacatagtttttgattccgatttatatcgttgtcggtcaacctgtatgcccgttttttcgggcgccccgagccttgtagagagtggggttatttttatagttactgcttgtgggagggagattatgttatctcctcatcccatgtgaccgggttagccggccagaatcactttttctttaccggacgacgccagccttctttctgagtctgcggcacacggctgatagctaatgcattttcgccgacattacgcgtcacagttgtacccgcagcaatggtcgcgcctttgcctactgttaccggggccaccagctgagtgtcggaaccaacaaacacatcgtcgccgataatggtcttaaatttattcgcaccatcgtagttgcaggtaatggttcccgcgccgatgttaacgttatcgccaatttccgcatcgcccaggtaagtcagatgaccagctttcgagcctttacccagacgcgcttttttcatctcaacgaagttaccgacgtgagcaccttccagcaactcagcaccaggacgcaaacgggcaaacgggccaatggtacaggccgctgccagattcgcatcttccacaacggtatacggactgatttcgcaatcatcgccaatcacgctgtttttaatcacgcaaccggtgccaattttcacgcgatgaccgagagtcacgttgccctcgatgataacgttagtatcaatttcaacatcgcgcccgtgagttagcgtaccacgcagatcaaaacgcgctggatcgcgcagcataacgcctgctaacagcagtttttcagcctgttcggactgataaacacgctccagacgggagagttgcaggcggttattcacgccttctacttcgcttaaacgttgcggatgaacggcgacgatttcacgcccttcctgatacgccagcgcaataatgtcggtgatgtagtattcgccctgagcattattgttggtcagcttcgccagccagcgtttcatatctgcgccgttggcaatcagaatgccggtgttgatctcctgaatctgacgctgctcgtcggtggcatctttgtgctcaacaatgccggtaactttgccgttttcacgggtgatacgtccataaccggtcggatcatccagtttcaccgtcagcagaccaatgccaccctgcggtttagcatcacgcagacgctggagtgtttcgacagagatcagcggcacgtcgccgtagagcattaaaatgtcttcatcatcggcaaagaaaggtgcggcctgctgcattgcatgacccgtacccagctgctctgcctgaagcacccagttaaggttgtcgtctttcagcgcctgttttagcagatcgccgccgtgaccgtacaccaggtgaacgtgcgctgcgcctaattcattcgcagcatcaatgacatgctgaaccatcgctttcccggcaagggtatgcagcactttcggaagatcggaatacatgcgcgtgcctttgcctgcggcaaggatcactacgctcatagcattattcaacatacgcgtcctgactgtaatttgagaacgaatttaaaccgcttcaccttgaaaaaactacatttttttcatcgtgaaatggacagaggataaattgttcaataacggattatccccgctgacgaaagcgccattttcgaccatcgtcacgccttttgtctgcagaaaattaaggcagtaccttaatttaagcgtcaggtggatgtttttgctcttatttcgatcaatgaataaacaggaaaacaggggggttttatatcagcaggatctatgtgaacgctattcaggacgggtcacacgcgcaaaaaaaagccagcctgtttccagactggcttttgtgcttttcaagccggtgttacatcgcttttttggtcaactcgataacgcgcagctgcgcgatcgctttggccagttccgcagacgcctgagcgtaatctacgtcgccgtgagagctgctaatgtgctcttcagccttacgtttcgcttccatggctcgcgcttcgtcgagatcctggccgcgaattgcggtgtcggccagaacggtcacgttgccaggctgcacttcaagaatgccgccagacagatagataaactcttcgtgaccgtgctgtttcacgatgcgaatcataccaggcttaatggcggtgagcagcggtgcgtggccagggtagatccccagttcaccttcgctacccgttacctggattttctcgaccagaccagagaacatttgttgctctgcgctgacgacgtccaggtggtaagtcattgccatatcaccctccgattaaggcgttaaagttttttggctttttccacagcttcttcgatggaaccgaccatgtagaacgcctgctccggcaggtgatcgtattcgccttccatgatgcctttaaagccacggatggtgtctttcagggagacgtatttacccggagaaccggtgaatacttctgccacgaagaacggctgggacaggaagcgctggatcttacgagcacgcgctaccaccagtttgtcttcttcagacagttcatccatacccaggatggcgatgatgtctttcagttcctgataacgttgcaggatggactgaacgccacgcgcggtgtcgtagtgttcctgaccaaccaccagcgggtccagctgacggctggtggagtccagcgggtcaacggccgggtagatacccagagacgcgatctgacggctcagtaccacggttgcgtcaaggtgcgcaaaggtggttgccggagacgggtcagtcaagtcatccgcaggtacgtatactgcctgtacggaggtgatagaaccagttttggtggaggtgatacgttcctgcagaacgcccatctcttccgccagggtcggctgataacctaccgctgaaggcatacggcccagcagtgcggatacttccgtaccggccagggtgtaacgatagatgttgtcaacgaacagcagaacgtcacgaccttcgtcacggaatttctcagccatggtcagaccggtcagagcaacgcgcagacggtttcccggcggctcgttcatctggccatacaccagggatactttgtcgataacgttggagtcggtcatttcgtggtagaagtcgttaccctcacgagtacgttcacctacgcccgcaaacacagagtaaccggagtgctcgatcgcgatgttacgaatgagctccatcatgtttacggttttacctacacccgcaccaccgaacagaccaactttaccgcccttagcgaacggacacatcaggtcgataactttgataccggtttccagcagttcctgagagtttgacagctcttcgtaggaaggtgctgcgcggtgaatcgcccaacgctcttcttcaccgatctcgcctttcatgtcgaccggttcacccagtacgttcatgatacggcccagagtcgctttacctaccgggacttcaatcgggtgttcgaggtcttttacatccagaccgcgacgcagaccgtcggaggaacccattgcgatggtacgtacgataccgccgccgagctgctgctgaacttccagcaccagacgctcattaccattttgcacctcaagagcatcgtacacgcgcggtacggcatcctgagggaattcgacgtcaactacggcgccgattacctggacaatctttccagtagccatcttaaatcctctacgaaataacctgtttaaaccgcggcggcccccgagacgatctcggtgagttcctgagtaatgctggcctgacgagctttgttgtataccaactgcagctctttaatcaggctgccgccattgtcggtcgcggctttcatcgccaccatacgggcggcctgctcgctggccaggttttcaaccacgccctgataaacctgagattcgacataacgacgcagcagggtatccagcaacgccttcggatcgggttcgtacaggtaatcccaggatttatgtttcagatcatcatcatctgatgccggtaacggcagcagctggctgatggtcggaacctgagacatggtgttaataaatttgttgctgacaatgtaaagcttgtccagacggccttcgtcgtaggcctgcaacatcacttttaccggaccgatcagttcggacagggaagggttatcccccatgccggtgacctgggcaacaacattgccgcccacggagttgaagaacgacacgcctttcgagccgatcattgcgaggtcgcattgaacgcctttgtcggtccaggtcttcatttccgccagcagttttttgaacaggttaatgttcaaaccaccgcacaaaccacggtcggtcgacaccaccaggtagcccacgcgtttaacgtcgcggtcttccaggtaagggtgcttatattccagattaccgtgtgcaaggtgaccaatcactttgcgcatggtttctgcataaggacggctggccgccatgcgatcctgcgatttacgcattttggaagcggcgaccatctccatcgctttagtgatcttttgcgtgttctggacgcttgcgatcttactacgtatctcttttgcgccggccatgagcttctcctcaatgccttgcggcctgccctaaggcaagccgccagacgttaccaggattgggttgctttgaaggaatcgaggatgcctttcagcttgccttcgatttcgtcgttgtagccaccggtctggttgatctcttgcatcaacggagcgtgatcacggtcgacgtaagccagcagagcggcttcgaagctgccaattttcgacagttcaacatccgccaggtaaccacgttctgctgcgaacagaaccagagactgctgcgcaacggacatcggcgcatactgtttctgtttcagcagttcggtcactttctgaccgtggtcaagctgcttacgtgttgcatcgtcaaggtcggatgcaaactgagagaacgctgccagttcacgatactgtgccagagcggtacggataccaccggacagttttttcatgatcttggtctgtgctgcaccaccaacacgggatacggaaatacccgggttaaccgcaggacgaataccggcgttgaacaggttggtttccaggaagatctgaccatcggtaatggagattacgttggtcggaacgaacgcagaaacgtcacccgcctgagtttcgataatcggcagtgcggtcagagaaccggttttccctttcacttcacctttggtgaaggcttcaacgtattcggcgttaacacgtgcagcacgctccagcagacgagagtggaggtagaaaacgtcgcccgggaatgcttcacgtcctggcggacgacggagcagcagggagatctgacggtaagcaacagcctgtttagacaggtcatcgtaaatgatcagcgcatcttcaccgcggtcacggaagtattcgcccattgcgcaaccggcatacggtgccaggtattgcagtgcagcggattcagacgcggttgctaccacaacgatggtgttagccagtgcgccgtgctcttccagtttacgtaccacgttagaaatggtggacgctttctggccgatagcgacatagatacatttgataccggaatcgcgctggttgatgatggcatcgatagccagtgcggttttacctgtctgacggtcaccgatgatcaattcacgctgaccacgaccgattgggatcatggagtcaacggctttataaccggtctgtaccggctgatctacggactgacgttcgataacgcccggagcgattgcttctacagcagagaagccgtcgtgatccagcggacctttaccgtcgattggtgcacccagagtgttaaccacacggcccagcaggccacggccaaccggaacttccaggatacggccagtacacttaactttcatgccttcggcaaggtcagcgtacggacccataacaaccgcacctacagagtcgcgctcgaggttcagtgcgatagcgtaacggttacccggcagggagatcatttcaccctgcatacaatcggccaggccgtgaatgcggataacaccgtcacttacagaaacaatagtaccttcgttgtgagcttcactcacaacattgaactgagcaatgcgctgcttgatcagttcgctgatttcggtggaattcagttgcatgctccagtccccttaagactgcaagacgtctgcaaggcgctcaagacgaccgcgtacgctgccatcaatgaccatatcacccgctcggatgataacgcctgccattacagacttatcgattttgcaattcagcttaactttgcgtgacagacgtttttccatcgcagcagaaattttcgcgagctgttgttcactcagtgcggcagcggaaatgacgtctacctcagcggtagcctcactcacggcacgcaggtgaataaactgctccagaacatccgggagcgcgttaagacgaccattttcagccataacccgaatcaggttctgaccgttttcgtccagttgctcaccacaaactgcgataaacgactcggcgagcgtttctggcgcaagcgcgccagagagaagctctgccatttgttcgtttttggttacctcggcggcaaacgccagcatgtcctgccagcgttctacactttggtgttcgacggcaaagtcaaaagctgctttggcgtaggggcgagctaccgtaataaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcacgtttacgctcggcttcaatttccgcctgcgcctgggccacgattttagtacgttcctgttctgcctcagctttcgcttcgtccagaatctgcgagcggcgtttgttcgcctgctcgatgattacctgggcttccgctttcgcttttttcagctggtcggtcgcgctggcctttgcaaggtcaaggtccttatgtgctcgttctgcggaagcaaggccgtcagcaatttctttttgacgtttttcgatggctgccattaatggcggccatacgtacttcatgcagaacagaacgaacaggacaaacgcgatggcctggccgaggattgttgcgttaagattcacagcacaatgcctctatttagttaacgttctgatattgctctttaaataaaagcaacgcttactacgcgacagcgaacatcacgtacagacccagacctacagcgatcatcgggatagcatccaccagacccataacgataaagaactgagtacgcagcagaggaatcagatcaggttgacgcgctgcgccttccaggaatttacccccgaggatgccgataccgatcgcagcaccgattgccgccagacccatcatcacagcggcagccatgtacagcagatccatattcaggttttccatgacagtctccagtttgtttcagttaaaacgtagtagtgttggtaaattaatgttcttcagacgccatcgacagatagacgatcgtcagaaccatgaagatgaaggcttgcagcgtaatgatcaggatgtggaaaatggcccacggcacattcaggatccactgtgaccaccacggcaacagaccagcaatcagaatgaaaatcagctcaccggcatacatgttaccgaacagtcgcaaaccgagtgaaactggtttggacagcaggcttaccccttcaaggattaagttgacaggaatgaacgcccagtgattgaacggctgcagcgtcaactctttcgtgaagccgccgatgcctttcattttgatgctgtagaacagaatcaggataaatacgcccagtgccatagacagcgttacgttcacgtccgcagacggaaccacacgcagtgcaggcagacccagtacatgttcagcaatgtacggcagcaggtcgataggcagtaaatccatcaggttcatcaggaatacccagacgaagatcgtcagggccagcggagcaatcagcttgcttttgccatggtacatgtctttcacgctaccattaacaaagccgatcaccagctcaatcgcggtctgaaacttacctggcacaccgctggtcgcctttttggctacgctacggaataaaaccaggaacaacagacccagcaccaccgagaagaacatggagtcaatattgattgtccagaaggtggctggggggttttgtggatccaccagcgagaatgtacgcaggtccagctgaaggttattcaggtggtgtcctatgtaatcctgcggcgtcatattttctgaagccatgatgccttttaccctttgttgttaattacagccggtgccagtatctgaaccaccagcaccaaaacccacgtaacgatcagcggcaagaataccgcctttaaaaccgccaacgccaccaccagtaacaccaacatcgccagaactttgaaagcttcgccaaatgcgaatgtccaggccacccggcctttcgctggtgtatgcgcctggtgacgccaggcaaatatcataaacaaaacgttaggcagaaagactgccaggcccccgcttattgcagagacgccccagaaggggtctttgaggctgaacagcaatccacttgctatcaccaccagtaactgaacgagcagaagcttccgagcaacgtttcgactcacgagcgacacagacatcacgtttttcactcctgctcccttcgaggtatgccgcgtgtcgtataaaactttctttaaggcttagagtcaagcatcaaaaagcggtcaaattatacggtgcgcccccgtgatttcaaacaataagtagccaaaaggtgaataaatgtttaaatatttttccagtgcatacaattgcgacttttctgctaaccctgttcgatcatgaaaaactgtaaataacgcgtaaacactggtgataaagcgtgcttcagatcacatattgcgcatgttcgcgcacagcatatttatttacttggcaaatgatgcctttgcaagtttatgatatttcagtctaaaaacagatactgttttaataaatgacatttacacaacaaaaaccacccattgacatttttaataatgttttaacagccaatgatggttcttagcgccgatttttagcagactgatattttcactaatgacttattttctgcttaccaaaaaaagccacgttatcttgttgatgcaaaagagtgaacgtggcgttaaatgtaaccagttatatcagtagaaaacctggttgttgttaacagtctaaccggtcaattttttatgatttttttgataaaaattaaattttatttgctttaatcaccaccagatgacgttcgccatccagggctggaacctgaagtttaaccactgattcgacctgatattcttcgggcaacaaagcgatttcatcttccggcatttgccctttcagcgcgtagaaacggccttgctcaccaggaagatggtggcaccagctcaccatatcgttcagagaggcaaaagcgcggctaattacgccatcaaatggcggctctgaaggaaactcttctaccctgctctgtactggttcaatattctccagtttaagctcatgttgcacctgacgaaggaaacgcacgcgtttaccaaggctatccaacagagtgaaatgggcttcaggacgcacgatagagagtggaatgcctggcagtcctggtccggtgccgacatcgataaaccgttcaccttgcagatacggtgccaccacaatgctatcgagaatatggcgtaccagcatctcattaggatcgcggaccgaagtcaggttgtacgctttgttccatttatgcagcatattcacgtaggcaataagctggtttttctggtgatcggtaagcgaaatacctgcgtctttcagcagtaaggagagtttgttgagcacggtgattacctgttcttgatgcgttgcctggtaagcgggtgcttaccaggcatttttaatgcgttatgcgctacgacgcagcataccctgttttttcagccacaccagcagaatggagatggccgcaggcgtgacgccagaaatacgcgaagcttggccgatagaggctggtttgtgatcgttaagtttggcgatcacttcgttagaaagaccggatacctggcggtaatccagtgtcgcgggtagcagggtgttctcgttacgcagctgcttttcgatctcatcttgctggcgcgcgatataaccttcgtatttaacctgaatctcaacctgttccgccgcctgttcgtctgtcaacgcaggggcaaacggcgtcagcgtggttaatttttcataagtcatttccggacgacgcagcagatcttcaccactggcttcacgggaaagcggcgcagtcaggtgagcattcacttcggctgcagcttccgccgacggggttacccaggtcgatttcagacgctgacgctcacgctcgatattctcaagtttctcgttaaagcgcgcccaacgttcgtcatccaccaggcccagttcacgaccgatttcagtcaaacgcagatccgcattatcttcgcgtagcatcagacgatattctgcgcgcgaagtaaacatacgatacggttctttggttcctaaagtgcacaggtcatcaactagtacgccgagatacgcctgagaacgtgccggagcccaaccttctttgtcagcagacagacgggcagcgttaagaccggccagcaaaccttgcgcagcggcttcttcgtaaccggtagtgccgttaatctgaccagcaaagaacagcccctggataaacttgctctccagcgtcggtttcaggtcgcgaggatcgaagaagtcatactcaatggcataacccggacgcacgatcttcgcgttttccatcccctgcatagagcggacgatttgcatctgcacatcgaacggcaggctggtggagataccgttcggataaatttcattagaggtcagtccttccggttcaaggaagatctgatgctgatttctgtcggcgaagcgcatgactttgtcttcgatcgacgggcagtagcgtgggccgacaccttcgatcacccctgcgtacattgggctacgatcgaggttactgcggatcacatcatgggttttctcgttggtatgagtgatataacacggcacctgctggggatgctgggacgcattgcccataaacgagaataccggcattgggttatcgccatgctgttgcgccagtacgctaaagtcgatggttcgagcatcaatacgcggtggtgtcccggttttcagacgaccaacgcgcagcggcagttcacgcaaacggcgagaaagcggaatggacggcggatcaccagcacggccaccgctgtaattatccagaccgatatgaattttaccgtcgaggaacgtcccaacggtgagcacgacggctttggcacggaacttcagtcccatttgggtaacagcaccgaccacgcgatcgttttcgacaataagatcttcaaccgcctgctggaagatcatcaggttcggttggttctccagcgccgtacgtaccgcctgacggtagagcacacgatccgcctgagctcgggtagcgcgaaccgccggtcctttgcttgcgtttagtatcctaaactggatacccgcctgatcgatcgctttcgccatcagaccgccgagtgcatccacttcttttaccagatgtcccttcccaataccgccgatcgccgggttgcagctcatctgccccagagtgtcgatattgtgtgtcaaaagcagagtctgttgacccatacgcgccgcggccatcgcggcctcggtgcctgcatgacccccgccaatgatgatgacgtcaaaaggatccggataaaacatggtgattgcctcgcataacgcggtatgaaaatggattgaagcccgggccgtggattctactcaactttgtcggcttgagaaagacctgggatcctgggtattaaaaagaagatctatttatttagagatctgttctattgtgatctcttattaggatcgcactgccctgtggataacaaggatccggcttttaagatcaacaacctggaaaggatcattaactgtgaatgatcggtgatcctggaccgtataagctgggatcagaatgaggggttatacacaactcaaaaactgaacaacagttgttctttggataactaccggttgatccaagcttcctgacagagttatccacagtagatcgcacgatctgtatacttatttgagtaaattaacccacgatcccagccattcttctgccggatcttccggaatgtcgtgatcaagaatgttgatcttcagtgtttcgcctgtctgttttgcaccggaatttttgagttctgcctcgagtttatcgatagccccacaaaaggtgtcatattcacgactgccaataccgattgcgccaaagcggactgcagaaagatcgggcttctgttcctgcaatgcttcatagaaaggagaaaggttgtccggaatatctccggcaccgtgggtggagctgataaccagccagatccctgaggcaggtaaatcttctaacagcggaccgtgcagcgtttcggtggtaaaacccgcctcttccagcttttcagccaggtgttctgctacatattcggcaccgccgagggtgctgccgctgataagagtgatatctgccataaaccgccacctttattaagagtggcgtattgtacgctgtgaacgcgttgggatctacctgtggaaaagtatgggattaaaaaagccgatcagggcttgatggtacgcatgatcgggttttgcaggacgatcaatgtctcggtggactgaatttcatcaattgtttggatcttgttgataagtacatgctggagagcgtcgatcgaacggcacatcacttttataaagatgctgtagtggccggttgtgtaataggcttcagtgacttcatcaaggctttccagctttgccagcgcggaagggtagtctttggcgctctttaatataatgccgataaagcagcctacgtcataaccgagctgcttcgggctgacatcaatacgcgccccggtaatgatccccgcctgcttcattttctctactcgaacgtgaatcgtccccggactgacgccaaattgtttcgccagttcggcgtaagcggtgcgcgcattgcccattaatgcttccaggatgccacggtccagattgtcgatcagataattttccataggattttcttatgcggattgatgattcattctattttagccttcttttttaatgaatcaaaagtgagttaggctttttattgaatgattattgcatgtgtgtcggtttttgttgcttaatcataagcaacaggacgcaggagtataaaaaatgaaaaccgcttacattgccaaacaacgtcaaattagcttcgtgaaatctcacttttctcgtcaactggaagaacgtctggggctgatcgaagtccaggcgccgattcttagccgtgtgggggatggcacgcaggataacttgtcgggctgtgaaaaagcggtgcaggtaaaagtgaaagctctgcctgatgcccagttcgaagtggttcattcactggcgaagtggaaacgtcagaccttagggcaacacgacttcagcgcgggcgaagggctgtacacgcacatgaaagcccttcgccccgatgaagaccgtctttctccgttgcactcggtctatgttgaccagtgggactgggaacgcgtaatgggcgacggtgagcgtcaattctcgactctgaaaagcacggtagaggcgatctgggcgggaattaaagcaaccgaagctgcggttagcgaagagtttggcctggcaccgttcctgccggatcagatccacttcgtacacagccaggagttactgtctcgttatccggatcttgatgccaaagggcgtgagcgggcgatagcgaaagatcttggcgcggtattccttgtcgggattggcggcaagctgagcgatggtcatcgccacgacgtgcgcgcaccggattatgatgactggagcaccccgtcagagctgggccatgcgggtctgaacggcgatattctggtgtggaacccggtactggaagatgcgtttgagctttcctccatggggatccgtgtagatgccgacacgctgaagcatcaactggcgctgaccggtgacgaagatcgcctggagctggagtggcatcaggcgctgctgcgcggtgaaatgccgcagaccatcggcggcggtatcggccagtctcgtttgactatgctgctgctgcaactgccgcatatcggccaggttcagtgtggagtatggccagctgctgttcgcgagagcgtcccttctctgctgtaataatttatcgccgccagcgtctgagcaggcggcttcgcatcccggtatcaaagcgccagatatgatcgaaaatgcgcatgatgccgggtttgccgtgtgccgacatcgccacggcatgaaagcgatgctgatgtacccgctgcagctctttcactttactcgtcacgtcgtcaggcaaccgctgagcgataaaatcagaaatcaccaccgcatcggcatcaaaccattccctgctttgcaagcgttccataatggcgcgaaaacaactggcaagatcggtgccgccacgaaactgctggcttaaaaaacggattgcttgttcgatgccttgtgggcctgaaagctcataacggacgatctcggtggaaaatagcataatatagcagcgccggttttctgcgagagcaatgcgcatcaaggccaggcagaacgctttcgcacactgttcattaaagccgcccattgagccggaagtatccacacagacaataaacggcccgcgcggctgttcatcgtaatctttatgtaccaccggacgttcgatcactttttcacgccacgactcaccgtgcaggcgataggtgagcaactgtttttccaccagccgacggtaaaactcatactccagttccgttatccctagtgtcgccagttctggcggcaggagacgtaaaatatcatcgctttgttgcagaccatcaacctgctcaggaaccgtcgccggttcgcgcaccatggtgcggaaggtttccatctgcgcatcgttgcgcggtattgatttggcttcccgagaacgccccagctgctctgccaggcgtttcagttccggctgttcgttaagaaattcaccgtatttcacaatcaactgatagtcgccacgtttaagctgaccggcgctcatatcccacagacgaccagctgcagtattgttatctgcgagaatcggttcaagttgtccgctcagcgtcatgcgttcctgaacttcactcaacagttgttcgcgttcttcttctaatagctgttgatttaacgtcgttgcttgcacgatcagacttaaacgccaacgctggagaaaaagcgtgtgtaacgctgaagtgatcgtgctgttagcatcaaccaactgtcgggcttgttctgcccatggagaattcagacgatgcagtaagtccaggatctgtggtagctgcacaataaactgtggcgtggagaggagctggctttgctgatagcacatcacctcttcggtgagttccggcgggactcgggcatctttcagccgactgcgcagcgcttcacgccagcggggaacatcatcagtgattgccgccttcaggcgtgggaatttttcaaagaagaccgccagctgcggtgaggccagcagtgcgatgatcatctcttcgatcaatccctcttcgctgacggccagcatcacattaagcgtatccagcgttagcattgttgtgcctggcgaatctgtgcaccgacatcctgtaggctggcttcaatgcgacctaaccagtcgccagggataaacagacatttttgctgttcgctgaataaagcgtgttgcttgcgccagtcgctttcaagctcttccagttgttgttttatttcaccaggcagaccttcagccgatgaaccgggaagtgccagcgtactgccttgtaaacttacatcgcgaacgacaagatgttgggcgctatcaacttccagattcagtttctgggcaaagccgataccgttcagtttaccgcgaatttcaccacctttgctcagccactgttccagcgcgctacgctcaaaggagatatgaaccacttccatatcatgcagttttaacggtttttgcagcagtagagtcagagtggaagcagtaacgttaacaggaagttgatactgctgacgacggctgaaaatgccgcccagacgaattaccgttaaggctgttttatcgctttgttgctgctggagttgcaggtgacgttgcacaatcgcgccaaggcgagtcaacatcccttgctgttgccaggcgtgaccggtcatcaatacatcaatttgttgttgtatcaaattcaggctttgcgcgtcataccacaggcaatctttcagcaaaatgagatctaccggggcaacagcactgcgaccgctaaaaaaggcgctggcctgcaataatcggatcgcttttttccagcgacgatccgagacataaggcgcatccggtaatttatccagttgctggcgcagcataaaaatcagctcaaatacatgatcgggcagcgtaatttcaccaatctctttctgccagcgttcatattcttcatctgtgacctgcaaggcatcaggaaccggattgtcgttttcatcctgttgactggtcagcatggagcggaaattcgctttatcctgcactttatctaaccacagacgaatcagcatgcggtcatataacgcttccagactgctgtctgcttccggcagctcgttggaggccgccaccagcagacgcatcgggattttttctacgtgtgcaccgttgcggaactggcgctcgttaatggcggtgagcaaggtattaagaattgccgggcccgctttccagatctcatccagaaagacaatttctgcttccggcaggtaaccgctggttaaacgttcatagcgcccttcatcttttagcgcctgaatagaaaggggaccaaaaacttcttccggcgtggagaagcgggtcatcagatattcaaacgcgcgggcattctgaaaggcgaattttaagcgccgggcgatcaaacttttggcaatacctggcgggccaaggaggaacacactttcaccacttaatgccgctaataaacacaagcggatggcgtggctacgttcataaagccccttttccaacgaactgctcaggcgggaaattctttccgctaataaatgagggtgagccataatgaagtggcgtcctttcgtcaaaagttctgcgtaaattgcgagtatagacgtttcttgctggtggctaaaatagtctcaaagggggggtatttttctttgagccaggttaatgtggccgcatttaggagtacgattttgccgttaatcgtgcatactgtgcgcttttttgtgggccaagggactaagcacacatttcatatttcaacgaaagactagtctatgagcactgataataagcaatcattgcccgcgattaccctcgcggcgattggagttgtctacggcgatattggtaccagcccgttatatacacttcgtgaatgtttgtccggccagtttggttttggcgttgaacgcgatgccgtgtttggctttttatcgctgatcttctggctgctaatctttgtggtttccattaaatatctcaccttcgtgatgcgggcagataacgccggtgagggggggatcctgacgttgatgtcgcttgccgggcgtaatacgtcggcgcgaaccacatcaatgctggtgattatggggctaatcggcggcagctttttctatggtgaagtcgtcataacacccgctatttcggtgatgtcagccattgaaggtctggaaatcgtcgccccgcagctggatacctggatagttcccctctcaattatcgttctcactttattatttatgattcaaaaacatggcacggctatggtcggtaagctgtttgcgccgatcatgctgacctggtttttgattctggcaggactggggttacgtagcattattgctaacccggaagtgctgcatgcgctgaatccaatgtgggcggtgcatttcttccttgaatacaaaacggtttcttttattgcattaggggcagtggtgttgtcgattacgggggtcgaggcgctgtatgctgatatggggcactttggtaagttccctattcgcctggcgtggttcaccgtcgtattaccttccttgacccttaattacttcggtcagggagcgctgttgttaaagaacccggaagcgattaagaacccgttcttcctgttggcaccggactgggcgctgatcccgctgctgatcatcgccgcactggcgacggtaattgcctcgcaggcggttatctctggcgtcttctcattgacgcgtcaggcggtacgtctgggatatttgtcgccgatgcgcattattcacacctccgaaatggagtcagggcaaatctatattccgtttgtgaactggatgctctatgtcgcggtcgtgattgtgattgtcagctttgagcactccagcaacctggcggcggcgtacgggattgcggtgaccggaaccatggtgctgacgtctattctctcgactaccgtggcacgtcagaactggcactggaataagtattttgttgcgctgatcctgattgctttcctttgtgtcgatattccattgttcaccgctaacctcgataaactgctctccggcggctggttgccattgagcctcggtactgtgatgtttatcgtgatgaccacctggaagagcgagcgtttccgcttgctgcggcggatgcatgaacatggtaactctctggaagcgatgattgcttcgctggagaaatcaccgcctgttcgcgtgcccgggaccgcggtgtatatgtcgcgtgcaatcaacgtcattccctttgcgctgatgcataaccttaaacataacaaggtattgcatgagcgggtgattctgttaactctgcgcaccgaagacgctccatatgtccataacgtccgtcgggtacagattgaacaactgtcgcccactttctggcgcgtggtggcaagttatggttggcgagaaacgccaaacgtagaagaagttttccaccgctgcggtctggaaggattaagttgccggatgatggaaacctccttctttatgtcgcatgagtcgttgatcctcggcaaacgcccgtggtatttgcgtctgcgcggcaagctgtacttgctgctgcaacgtaatgcgctgcgtgcaccagatcaatttgaaatcccgccaaacagggttatcgaactgggtactcaggtcgaaatctaacgccagacgcctcctttcttcataagggggcgtttttgttttcatggttaatcaccatgtaaaacgtttcgaggttgatcacatttccgtaacgtcacgatggttttcccaactcagtcaggattaaactgtgggtcagcgaaacgtttcgctgatggagaaaaaaatgaaaaaaggcaccgttcttaattctgatatttcatcggtgatctcccgtctgggacataccgatacgctggtggtgtgtgatgctggtttacccatccccaaaagtacaacgcgtatcgatatggcattaacccagggtgtaccttcttttatgcaggtgctgggcgtcgtcacaaatgaaatgcaggtcgaggcggccattatcgcggaagagatcaaacaccataatccgcaactccacgaaacgttgctcactcaccttgagcagctgcaaaaacaccagggaaataccattgaaattcgttacaccacgcatgaacaattcaaacaacaaaccgcagaaagtcaggcggtaattcgcagcggagaatgttctccgtatgcgaatatcattctctgtgctggcgtgacgttctgaggccgtcatggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggcatctatactcgcgatgccggtacgcttttatggctggggaaagaaacgacatttaccgggccaaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagatttgcgatgacgttaccgtttttcgtgatgggcaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcctggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgatttcattcgtctgtttaatgtgaaaactccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaaaaaaatgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattctccagcaaacctcagtgaacgccattatggcggtcgggatgacgctggtgatcctgacgtcgggcatcgacttatcggtaggttctctgttggcgctgaccggcgcagttgctgcatctatcgtcggcattgaagtcaatgcgctggtggctgtcgctgctgctctcgcgttaggtgccgcaattggtgcggtaaccggggtgattgtagcgaaaggtcgcgtccaggcgtttatcgctacgctggttatgatgcttttactgcgcggcgtgaccatggtttataccaacggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaacgaagcggcaacgcgtctttctggtatcaacgtcaataaaatcaaaatcatcgtctattctctttgtggtctgctggcatcgctggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaataacgactacaggacatcttgaatatgaacatgaaaaaactggctaccctggtttccgctgttgcgctaagcgccaccgtcagtgcgaatgcgatggcaaaagacaccatcgcgctggtggtctccacgcttaacaacccgttctttgtatcgctgaaagatggcgcgcagaaagaggcggataaacttggctataacctggtggtgctggactcccagaacaacccggcgaaagagctggcgaacgtgcaggacttaaccgttcgcggcacaaaaattctgctgattaacccgaccgactccgacgcagtgggtaatgctgtgaagatggctaaccaggcgaacatcccggttatcactcttgaccgccaggcaacgaaaggtgaagtggtgagccacattgcttctgataacgtactgggcggcaaaatcgctggtgattacatcgcgaagaaagcgggtgaaggtgccaaagttatcgagctgcaaggcattgctggtacatccgcagcccgtgaacgtggcgaaggcttccagcaggccgttgctgctcacaagtttaatgttcttgccagccagccagcagattttgatcgcattaaaggtttgaacgtaatgcagaacctgttgaccgctcatccggatgttcaggctgtattcgcgcagaatgatgaaatggcgctgggcgcgctgcgcgcactgcaaactgccggtaaatcggatgtgatggtcgtcggatttgacggtacaccggatggcgaaaaagcggtgaatgatggcaaactagcagcgactatcgctcagctacccgatcagattggcgcgaaaggcgtcgaaaccgcagataaagtgctgaaaggcgagaaagttcaggctaagtatccggttgatctgaaactggttgttaagcagtagttttaatcaggttgtatgacctgatggtgacataaatacgtcatcgacagatgaacgtgtaatataaagaaaagcagggcacgcgccaccctaacacggtggcgcattttatggacatcccgaatatgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaggctgtggctgctgggcgtagcggtgcgaatatcgcgtttattgcctgtacgggtgatgacagcattggtgagagcgttcgccagcagctcgccactgataacattgatattactccggtcagcgtgatcaaaggcgaatcaacaggtgtggcgctgatttttgttaatggcgaaggtgagaatgtcatcggtattcatgccggcgctaatgctgccctttccccggcgctggtggaagcgcaacgtgagcgtattgccaacgcgtcagcattattaatgcagctggaatcaccactcgaaagtgtgatggcagcggcgaaaatcgcccatcaaaataagactatcgttgcgcttaacccggctccggctcgcgaacttcctgacgaactgctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgataccattgctgccggagatacctttaacggtgcgttaatcacggcattgctggaagaaaaaccattgccagaggcgattcgttttgcccatgctgccgctgcgattgccgtaacacgtaaaggcgcacaaccttccgtaccgtggcgtgaagagatcgacgcatttttagacaggcagaggtgacgcttggctacaatgaaagatgttgcccgcctggcgggcgtttctacctcaacagtttctcacgttatcaataaagatcgcttcgtcagtgaagcgattaccgccaaagttgaagcggcgattaaagaactcaattacgcgccatcagctctggcgcgtagcctcaaactcaatcaaacacataccattggcatgttgatcactgccagtaccaatcctttctattcagaactggtgcgtggcgttgaacgcagctgcttcgaacgcggttatagtctcgtcctttgcaataccgaaggcgatgaacagcggatgaatcgcaatctggaaacgctgatgcaaaaacgcgttgatggcttgctgttactgtgcaccgaaacgcatcaaccttcgcgtgaaatcatgcaacgttatccgacagtgcctactgtgatgatggactgggctccgttcgatggcgacagcgatcttattcaggataactcgttgctgggcggagacttagcaacgcaatatctgatcgataaaggtcatacccgtatcgcctgtattaccggcccgctggataaaactccggcgcgcctgcggttggaaggttatcgggcggcgatgaaacgtgcgggtctcaacattcctgatggctatgaagtcactggtgattttgaatttaacggcgggtttgacgctatgcgccaactgctatcacatccgctgcgtcctcaggccgtctttaccggaaatgacgctatggctgttggcgtttaccaggcgttatatcaggcagagttacaggttccgcaggatatcgcggtgattggctatgacgatatcgaactggcaagctttatgacgccaccattaaccactatccaccaaccgaaagatgaactgggggagctggcgattgatgtactcatccatcggataacccagccgacccttcagcaacaacgattacaacttactccgattctgatggaacgcggttcggcttagatttacgctgtcttttgatcaaattattaccatcggttgttttcagaagcatgaacattgctgctgaagcaacagtaataatgcccattgtgataaacgtatagtggaattgttcgacagtcgttgtgccttccattccttcataaacgcgaaggacggccgcacttacagcaacgcctaaactaatcgacagttgctgcgtgaccgccagaacactgttaccgctgctggcattgtcatcggtcagatcggcaagtgtgatggtattcatcgcggtaaactgcgtcgacatagccatccctaatataaacaacggcaagatcagcatccatatagccattgctggtgattgcaaagagaactgagcgatcattagcccaataatcaccgtgatccccactaacgtatggcgatagcccagacgacgtaagacttgggtaaccatcgattttgcaataatggaacctaacgctgtcggtgccatcatacagccagcaataaacgcctgataaccaaatcctacctgtaacatcaatggcataaggaacggtacacagccggtccccagacgggttgcaatattgcctacgataccgatcgagaaagtgcgggttttaaataaatctaatgaaattaatgggtttggcgtgcgtcgtgcatggagaatatagagaagcagtaacccgatgctggtgacaattaccgtcaaggcaatccagctggcgacaatcttttccccgaatagctctattccgcttgagaagagaacaaggctgaggccaaacagcaaaaagccagtgatatcgaatctgcgtcgtgcggtggtgaaattgggcatatgtttgcgcgcgtaaagaaggcccgcaatacctatggggatattgattaaaaatatccagtgccaggttgcccaggtgaccagcacgccgccaagaacggggcctaaaattggccccaccagacccggcatggcgacaaaattcaatactggaagaagttcattacgaggataagcgcgcagtaaggccagccgagcaacaggcatcatcattgcgccgcctatcccctgaataacccggaagacaaccagctgtggtagcgaattagaaagtgcgcaggccagagaacccaatgtgaacagactcacggcaagggtaaaaatgcgacgcgtaccgaagcgatcggctagccatccgcttaccggaataagcatcgccaccgtcagcgtataactgatgatggctgattgcatcgcgagaggagaacgattaaggctatgagcgattgcgggtaaggcggtattaagaatagtggcatcaagtgcctgcatgaagaaggccatcgccgcgatccacggcaaacccgccatactgcgcttctttttatcgctcattcaatgtcctgttatcgggttatcacttatcaggtgagcgtagcagcgcctgacaagctttaaatgccgcgtcgccatcgctttggataatcgcatcgacaatcgcctgatgcagatccagctttatcactgtgtcgctggtaattgacgtgaagtaagtgtgataaaccgaatggaatagcgaggcgaatgaggtcaaaaacggattggcgctcatttcatagatatgctcatgccaggccatatcgacttcgatccagcgttcacggcgaaagttctcttttaatgccgccatttcggccattaacgtattgagatgcgctttctgttccgcggtgccaaccgttgctgccagtaggcaggcttgcggctccagacagatacgcataaccagaaagtgatcgatgacctgatgaaagttctcttctgtcatccaccaggtaagcaattcctgatcaagaaaattccagttcgattgtggcatgacccgagtaccaattcgcggtcgcggtaaaaccatcccttttgccgttaacgttttgaccgcttcgcgtaccgctgtacgactcactccaaattgctcgcccagctcaatctcaccgggcaaaatggtgccgggttcatattcaccttttaagatccgttgcgccagcttctcagccagaacatacgaaaggtttttctgtgcagctaactgttgtgcgcttaaaggcattacttatcttcctttttctttttattcctccttagtatgccaccaggaagtgtgattacggttgcaaaaacggcaaattgcttgttttatggcacattaacggggcttttgctgaaaaaatgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaagcgtattatgcacaccccgcgccgctgagaaaaagcaaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgcagtgctcacacagattgtctgataggaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtatgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggagctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaagattttcagcctgatacagattaaatcagaacgcagaagcggtctgatgaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaatcatccttagcgaaagctaaggattttttttatctgaaataaccctctccgaagtaaatccttctaccggcatccttgccagccattcatattaatacacttcatccagcacgttaattttcaaaagatcgcgaatcaacgcatttttatcgctattttgcagccatatggcataaagcggccgtgaaagtgttgtgctatcgacaacggtatgcaggccgccttttttacgcgcccagctgacgggtagccaggtgcaaccattaagcatcgcaatctgttgctgtgccagttcagcagaactggttgtcagaatgggcacttcgtcagcaccgatcaaacctgcctcatgctgttgaaaatctggcccccactcaagtcgcagataattaagatctccctttagttttgaaggggcactggtataaagcgctaaagtgaaatatcccagcaactgactactaaattcgtccattttgggcgcttcagtggtaataagaagatcaagctggcgttcatgcagctgttttaccagagactgccgttgggcaattcgcgcttcgaactgtaagcctgtatgggcatcctgattttgatacaagcgtcccagccactgattaagcatacattcccacaacgaggcgctggcaccgatagaaaactcgttatgtcgtgaggtatgcgccacctccttacgggcggcctgccaggtgctcatgagcgtttctgcataaggcagtagtttttcaccggcagcggttaaacggatattgtttctgtggcgggtgaaaaggttcacacccagttgattttccagttgtctgattcgaaagctcactgctgactgggtcagatagagcgattcagccgctcgaccaaagtgacgcgttcggctaacttccaggaaagtttttaacaattccgtatccacagtgctctccgcaaaattatttgtcgttatgatttaaatgttttgttttacactctgtcaagcgtaactaatactccgcgccataactagctcggtcaaagaattaggagcgtgcaggatggcggaaagctttacgacgactaatcgatatttcgacaataaacattatccacgtggattctctcgtcatggtgatttcaccatcaaagaggcacaactgcttgagcgtcatggttatgccttcaatgagttggatcttggcaaacgcgagccggttaccgaggaagagaaactcttcgtagcagtatgccgtggcgaacgtgagccagtgacagaagcagaacgcgtgtggtccaagtatatgacgcgtattaagcgtccaaaacgttttcacaccctttccggcggtaaaccgcaggttgaaggtgctgaagactacaccgattctgacgattaataaaaagggcgaaatgccctttttttatgtcagtagtttctgcagatggatgagcaaacggtcaatcgctcgatagctaactgcctcctgcaaatgctgacgtgtgataatgtcagactgatcaatatcagcaatggttcgtgcaactttcaataaccgctgccaggcacgaatcgataaccccagatggatcagtgttccttccaaccacatcgcatcttcgctctcaagtttgcagaattggcgtatttccggactatccagccaggcattcagtttattctgccgcttaaattggcgctctctggcggccattacgcgttgtttaacggtggcgctgctttctcccggcactaccgttttactcaaaatgccggggggtggtaatgggatctccagtgagagatcgaagcggtcgagaaagggccccgagagccggttgagataacgtaatgtctgttctggcgtgcagcggttatggtttccctgataatgtccggtagggctgggattcatcgccgcaacaagctggaaacgggctggataggttatttttgctcgtgtgcgtgaaagatggatctgcccggattcaatcggctctcgcaaggcatccagtgtacgccgttcaaattcaggtagctcatcaagaaaaagcacgccgttatgcgccagcgaaatttcaccgggccctggaattgcgccaccgcctaccatcgcagttaacgatgcactgtgatgaggtgagcggaacgggcgctgccgccattgtttttgtactgattcagcatttaccagacttaatatcgcagcactctccagtgcctcttcattgcttaaatctggcaacaggccattaatacggctggcgagcattgttttacctgttcccggcggcccaatcagtaaaaggttgtgcccgccagcagcggtaatttccagtcctcgctttccttgttcctgaccgataacatcactgagatcatgttgtagcgcccgggatactgcatcagttggtttcgggcgttcgagagcgtgcttaccttccagaaacgcacagacagcttgcagatgatcggctatcaggcatccttcaccgttaattagccccacttcatcttcgttatctttcgcgacgataatttttctgcccgacttaatagcttcagttgcactggagattgcgccgggaacgccacgcagagcgcctgtaagcgccagttctccgactaattcatattcatctaacttattggctgtaagctgttctgaggccgccagcaacgcaatggcgataggtaaatcatatcgtcccccttcttttggcagatcagctggagccaggttgatggtgatttttttcgccggatattcatatccgctattgataatggcgctgcgcacgcgatcgcgagcttcttttaccgttgtttctggtaagcccaccatcgttaagccgggtagacctttactgatatgtacctcaacagtgatcgggggcgcatttactcccagggctgcgcgggtatgaacaattgacagtgacataagccctccttgagtcaccattatgtgcataagatatcgctgctgtagcccgctaattcgtgaattttagtggctgattcctgtttatttgtgcaagtgaagttgagttgttctggcggtggaatgatgctcgcaaaaatgcagcggacaaaggatgaactacgaggaagggaacaacattcatactgaaattgaatttttttcactcactattttatttttaaaaaacaacaatttatattgaaattattaaacgcatcataaaaatcggccaaaaaatatcttgtactatttacaaaacctatggtaactctttaggcattccttcgaacaagatgcaagaaaagacaaaatgacagcccttctacgagtgattagcctggtcgtgattagcgtggtggtgattattatcccaccgtgcggggctgcacttggacgaggaaaggcttagagatcaagccttaacgaactaagacccccgcaccgaaaggtccgggggttttttttgaccttaaaaacataaccgaggagcagacaatgaataacagcacaaaattctgtttctcaagattcaggacggggaactaactatgaatggcgcacagtgggtggtacatgcgttgcgggcacagggtgtgaacaccgttttcggttatccgggtggcgcaattatgccggtttacgatgcattgtatgacggcggcgtggagcacttgctatgccgacatgagcagggtgcggcaatggcggctatcggttatgctcgtgctaccggcaaaactggcgtatgtatcgccacgtctggtccgggcgcaaccaacctgataaccgggcttgcggacgcactgttagattccatccctgttgttgccatcaccggtcaagtgtccgcaccgtttatcggcactgacgcatttcaggaagtggatgtcctgggattgtcgttagcctgtaccaagcacagctttctggtgcagtcgctggaagagttgccgcgcatcatggctgaagcattcgacgttgcctgctcaggtcgtcctggtccggttctggtcgatatcccaaaagatatccagttagccagcggtgacctggaaccgtggttcaccaccgttgaaaacgaagtgactttcccacatgccgaagttgagcaagcgcgccagatgctggcaaaagcgcaaaaaccgatgctgtacgttggcggtggcgtgggtatggcgcaggcagttccggctttgcgtgaatttctcgctgccacaaaaatgcctgccacctgtacgctgaaagggctgggcgcagtagaagcagattatccgtactatctgggcatgctggggatgcacggcaccaaagcggcaaacttcgcggtgcaggagtgtgacctgctgatcgccgtgggcgcacgttttgatgaccgggtgaccggcaaactgaacaccttcgcgccacacgccagtgttatccatatggatatcgacccggcagaaatgaacaagctgcgtcaggcacatgtggcattacaaggtgatttaaatgctctgttaccagcattacagcagccgttaaatcaatgactggcagcaacactgcgcgcagctgcgtgatgaacattcctggcgttacgaccatcccggtgacgctatctacgcgccgttgttgttaaaacaactgtcggatcgtaaacctgcggattgcgtcgtgaccacagatgtggggcagcaccagatgtgggctgcgcagcacatcgcccacactcgcccggaaaatttcatcacctccagcggtttaggtaccatgggttttggtttaccggcggcggttggcgcacaagtcgcgcgaccgaacgataccgttgtctgtatctccggtgacggctctttcatgatgaatgtgcaagagctgggcaccgtaaaacgcaagcagttaccgttgaaaatcgtcttactcgataaccaacggttagggatggttcgacaatggcagcaactgttttttcaggaacgatacagcgaaaccacccttactgataaccccgatttcctcatgttagccagcgccttcggcatccatggccaacacatcacccggaaagaccaggttgaagcggcactcgacaccatgctgaacagtgatgggccatacctgcttcatgtctcaatcgacgaacttgagaacgtctggccgctggtgccgcctggcgccagtaattcagaaatgttggagaaattatcatgatgcaacatcaggtcaatgtatcggctcgcttcaatccagaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgccatctgccagagcacaaccacatcacaacaaatccgcgcctgagcgcaaaaggaatataaaaatgaccacgaagaaagctgattacatttggttcaatggggagatggttcgctgggaagacgcgaaggtgcatgtgatgtcgcacgcgctgcactatggcacttcggtttttgaaggcatccgttgctacgactcgcacaaaggaccggttgtattccgccatcgtgagcatatgcagcgtctgcatgactccgccaaaatctatcgcttcccggtttcgcagagcattgatgagctgatggaagcttgtcgtgacgtgatccgcaaaaacaatctcaccagcgcctatatccgtccgctgatcttcgtcggtgatgttggcatgggagtaaacccgccagcgggatactcaaccgacgtgattatcgctgctttcccgtggggagcgtatctgggcgcagaagcgctggagcaggggatcgatgcgatggtttcctcctggaaccgcgcagcaccaaacaccatcccgacggcggcaaaagccggtggtaactacctctcttccctgctggtgggtagcgaagcgcgccgccacggttatcaggaaggtatcgcgctggatgtgaacggttatatctctgaaggcgcaggcgaaaacctgtttgaagtgaaagatggtgtgctgttcaccccaccgttcacctcctccgcgctgccgggtattacccgtgatgccatcatcaaactggcgaaagagctgggaattgaagtacgtgagcaggtgctgtcgcgcgaatccctgtacctggcggatgaagtgtttatgtccggtacggcggcagaaatcacgccagtgcgcagcgtagacggtattcaggttggcgaaggccgttgtggcccggttaccaaacgcattcagcaagccttcttcggcctcttcactggcgaaaccgaagataaatggggctggttagatcaagttaatcaataaatacaaaaaatgggacggcacgcaccgtcccatttacgagacagacactgggagtaaataaagtatgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaataatggctgactcgcaacccctgtccggtgctccggaaggtgccgaatatttaagagcagtgctgcgcgcgccggtttacgaggcggcgcaggttacgccgctacaaaaaatggaaaaactgtcgtcgcgtcttgataacgtcattctggtgaagcgcgaagatcgccagccagtgcacagctttaagctgcgcggcgcatacgccatgatggcgggcctgacggaagaacagaaagcgcacggcgtgatcactgcttctgcgggtaaccacgcgcagggcgtcgcgttttcttctgcgcggttaggcgtgaaggccctgatcgttatgccaaccgccaccgccgacatcaaagtcgacgcggtgcgcggcttcggcggcgaagtgctgctccacggcgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttagggaaaaatgcctgatagcgcttcgcttatcaggcctacccgcgcgacaacgtcatttgtggttcggcaaaatcttccagaatgcctcaattagcggctcatgtagccgctttttctgcgcacacacgcccagctcaaacggcgttttctcatcgctgcgctctaaaatcatcacgcggttacgcaccggttcggggctgttttccagcaccacttccggcaacaatgccacgccacagccgagtgccaccatcgataccatcgcttcatgcccgccaaccgtggcgtaaatcatcgggttactgattttattgcgtcgaaaccacagttcaatgcggcggcgtaccggcccctgatcggccataataaacggcaccgttgaccagtccggcttctctaccgacacctgattacgcaccgggcagggcagcgcgggggcaatcagcactactgccagattctccagcatcgaaaacgccactgcgccgggcaaggtttccggtttacccgcaatcgccagatccgcttcaccagtgaccaccttttccatcgcatctgccgcatcaccagtagtaagtttaatctccaccgacgggtgttccgcgcggaagcgatccagaatcggcggcagatggctgtaggcagcggtcaccgagcagaagatatgtaattcgccagagagcgacggcccttgctgatcgatggtgtggcgcaactgctgatactgcaacagcgtttgctgggcgaaaacgcgcagctcttcgcccgcttcagtcagcgtcaccgtgcggttatcgcgcacaaacagcggctgaccgagatcttcttccaggcgctgaatctgccgtgagagcgtggatgggctaacgtgcatcgcccgcgcgctgcggccaaaatggcggctttccgccagatgcaggaaggttttcagatcgcgtaaatccacagggacagccctcgatgttgacgttgcaaaaattgcaatgtgacgttgtgaatatatcaatttccgcaataaatttcctgtcatatagtgaattcaatctcgcaaacgcgaaccgaacaataagaagcacaacatcacgaggaatcaccatggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaagtgcgcgctgatgccctcaccccgaccctctcccacagggagagggagaaaacactcaaggccttctcctggagaaggccttgctattagttgcggtacagcaccttaatgatgtgatatccgaactgggtgtgcagcgggccggtcggctccagtaccggacaagagaaaaccactttatcgaacgccggaaccatctgaccctggcggaattcacctaaatcaccgccgcgtttgcctgatgggcaaatggagtgtttcttcgccagcttgccgaaatcggccccgttcttaatctgctcgagaagatccagagccagtttctcttcttttacaaggatatgcagtgctgctgctgtttttgccatgatcgtgccttgagtgaataattgtcaggcggcgattttagcatgatccgcagatgctaacgtaattgtcagtcagggagtggctggtacatatatggcaaaagcccggaaaatccgggcctcgcaggtccctcaaggggagaaaacttagggcctctatgggctacaaagtcattatcggggatggttattttattgtcaatttatgagcgatatggcattgattgacttgatgaccgccctctgtatgtctgcaaccaactcatgtggcaaacattgattaagataccctctgtaagtccttgctctgtttaatctgtttcgactgacttgttgtaccaggtcggctttggcccaacgaatctgctgatcaaagaattgcaggtcattgataacattactggctatttcaacatgcattccacgttttaacttgtctggtcgcgagtggttgataatggaacgacgatgcatgcgttgccattaatttttccgttgagcacgacaactaacctgttttttatcatttcaggaggaatgcggccatcgtaatacgtcgtgctgaacggtccattttggctaacaggatagttaccaaagttgcattccagtatttcaccaaccttagggctgaaattaatcgccacgagtaaacctctccttagtaaactctgaaaaagtaataacacaacgttacgacccgatattttctaagtctaatggattcacgatgaactccgatttcggtcttctctctctgatttaaacatccgcagccaaccggttagcggcttacacgcggtcacattcaaatgcgattctgctacaatcctccccccgttcgaagattgagcaatacacctatgcgtctaaaccccggccaacaacaagctgtcgaattcgttaccggcccctgcctggtgctggcgggcgcgggttccggtaaaactcgtgttatcaccaataaaatcgcccatctgatccgcggttgcggttatcaggcgcggcacattgcggcggtgacctttactaataaagcagcgcgcgagatgaaagagcgtgtagggcagacgctggggcgcaaagaggcgcgtgggctgatgatctccactttccatacgttggggctggatatcatcaaacgcgagtatgcggcgcttgggatgaaagcgaacttctcgttgtttgacgataccgatcagcttgctttgcttaaagagttgaccgaggggctgattgaagatgacaaagttctcctgcaacaactgatttcgaccatctctaactggaagaatgatctcaaaacaccgtcccaggcggcagcaagtgcgattggcgagcgggaccgtatttttgcccattgttatgggctgtatgatgcacacctgaaagcctgtaacgttctcgacttcgatgatctgattttattgccgacgttgctgctgcaacgcaatgaagaagtccgcaagcgctggcagaacaaaattcgctatctgctggtggatgagtatcaggacaccaacaccagccagtatgagctggtgaaactgctggtgggcagccgcgcgcgctttaccgtggtgggtgacgatgaccagtcgatctactcctggcgcggtgcacgtccgcaaaacctggtgctgctgagtcaggattttccggcgctgaaggtgattaagcttgagcagaactatcgctcttccgggcgtattctgaaagcggcgaacatcctgatcgccaataacccgcacgtctttgaaaagcgtctgttctccgaactgggttatggcgcggagctaaaagtattaagcgcgaataacgaagaacatgaggctgagcgcgttactggcgagctgatcgcccatcacttcgtcaataaaacgcagtacaaagattacgccattctttatcgcggtaaccatcagtcgcgggtgtttgaaaaattcctgatgcaaaaccgcatcccgtacaaaatatctggtggtacgtcgtttttctctcgtcctgaaatcaaggacttgctggcttatctgcgcgtgctgactaacccggacgatgacagcgcatttctgcgtatcgttaacacgccgaagcgagagattggcccggctacgctgaaaaagctgggtgagtgggcgatgacgcgcaataaaagcatgtttaccgccagctttgatatgggcctgagtcagacgcttagcggacgtggttatgaagcattgacccgcttcactcactggttggcagaaatccagcgtctggcggagcgggagccgattgccgcggtgcgtgatctgatccatggcatggattatgaatcctggctgtacgaaacatcgcccagcccgaaagccgccgaaatgcgcatgaagaacgtcaaccaactgtttagctggatgacggagatgctggaaggcagtgaactggatgagccgatgacgctcacccaggtggtgacgcgctttactttgcgcgacatgatggagcgtggtgagagtgaagaagagctggatcaggtgcaactgatgactctccacgcgtcgaaagggctggagtttccttatgtctacatggtcggtatggaagaagggtttttgccgcaccagagcagcatcgatgaagataatatcgatgaggagcggcggctggcctatgtcggcattacccgcgcccagaaggaattgacctttacgctgtgtaaagaacgccgtcagtacggcgaactggtgcgcccggagccgagccgctttttgctggagctgccgcaggatgatctgatttgggaacaggagcgcaaagtggtcagcgccgaagaacggatgcagaaagggcaaagccatctggcgaatctgaaagcgatgatggcggcaaaacgagggaaataatcaaggccggaaaagatgcgtcagcatcgcatccggcacttactcattaatgcacttccagcggccagtggacatagctctgccactggctttcctgagcaataatctctttacccagcggatgttgggttagccaaccttgcggaagcgtcaaggtcaacagttcatggttagcctgtaatgtcatctctggcacgagatcgtcacggcgacggctggcaaaaatgatggccaggcgtagtaaacggcagagttgttctgcgacgcgcggcggtacggcattttgctgatgcagcgatgagagatcgaccggattagtctggttgagcagtagcgtcgccagcaattttttctgtgcgggggtaaaaccgggaagatccagattacgcaccagataagcagcgtgttgcggcgcttgtttgaagtcaacgctcaggccgatttcatgaagctgacaggcgctgatgagcaaatcgcggcttattgcttcaagatgccattcgttttccacctgatcgaagaagttagccgcaactttggctacgcgctgtgcctgatcaatatcgatcataaagcggcgttgaatattacgcagcgtacggctgcgaatatcctgctcgacggccagatgcaacatgccgtagaccaggccttcacgcagcgcaccgcccgccagggtcatacactgaatattcagttcggtaaaaatggcgatcaggatcgccagaccactcgggaacactaacgcacgttccagcgtcagcccgtcaatctccagttcctccagccgaccgcaatgaatggctcgctgtttcaattgctgcaacttttccagggtaatgcgttcatccatcccctgtgccatcatgatttcctgtaacgcctgcacggtgccggaagcaccaacgcacactttccagccgtgataccgtaattcatcggcaaccggacgtaacacttcgcgtgccgctttttctgcagcatcaaaattttcctgccccagattacgatcggcaaaatagcgttccagccaggtgacgcagcccatcgacaggctgaacaacgaggtggtttgtgcacccgtgccggttaccagttcagtactggctccgcctatatccaccaccaggcgctgatcggcaccaccagtggtgtgagcaacgccctgataaatcagacgtgcttcctcttcaccgctgatcacctgtaccggacaaccgagaatttcctgcgctttggcaataaaatcacccgcattgacggcaaggcgtaacgtcgccgtagcgacaacgcgaatttgcgagggaggaatatcttgcagacgttcagcaaacaggcgcaaacattgccaaccgcgctccattgcttcattggagagggcattttcgctattcaggccagcagccagacgcactttgcgttttattcgcgtcagcgtctggatgcttccagccacctcgcgcacaaccagcatatgaaaactattcgaaccgagatcaatggctgcatacagcgacgaggtggaacccatactcttcatccttcaatctgtctctgtgttggctgcattctttcacctgaatcacttactacagtaagctcatcgggattcattctcttgccatcttgatacagtttgaatgattttgagtatgacattttttatttaacctgaacgacgacgattacgcggagcgccagtacgacgcggaccattgcctgtgcgcgggcgcgtgaggcgcagcggttttggcagatcggtcatcaatgcgtccggattgtatttgcttaccggaattgagtgaccaatataggtctcaatagcaggcaaattcaatgcatactcttcacacgccaggctgatagagtgaccgcttgcgcctgcgcgacctgtacgaccaatacggtgaacgtaatcttcacagtcatcgggtaaatcgtagttaaagacgtgcgtcactgccggaatatgcaaaccacgcgcggcaacgtcggtggcaaccagaatatccagatcgccacgggtaaattcatcaagaatacgcagacgttttttctgcgcgacatcgcctgtcaataaaccgacacgatgaccatctgctgccaggtggccccagatctcttcacaacggtgtttggtgttggcgaaaataatcgctctgtctggccactcttcttcgatcagcgtttgcagcaaacgcattttttcttcgttagaagggtagaaaagctcttctttaatacggtggcccgttttctgttccggttccacttcaatatattcggcattgttcatctgctcgaacgccagttcacgtacccggtacgaaagcgtggcggagaacagcatgttgaggcgctggtttgcaggcggcatacggcggaacagccagcggatatctttaataaagcccagatcgtacatgcgatcggcttcgtccagtaccaccacctgaatggcaccgaggttaatgtggttctgcttggcgtagtcaattaaacgccccgtggtgccaatcagaatgtcaacgccgctttccagcactttcagctgtttgtcgtagccatcaccaccgtaagccagacccagcttcaggccagtagcttccgccagcggttctgcgtcggcatggatctgcacggcaagttcacgcgtcggtgccataattaaggcacgcggctgattcaccttgcgatcggcaatcgcaggatgagagagaagataatgaaacgttgacgtaagaaacgccatcgttttcccggtaccggtttgcgcctgcccggctacgtcacgacccgccagcgtcagcggaagggccagtgcctgaatgggcgtacagttatgaaacccttttttttcaagggcttctacaaccttcggatgcagggcgaagtcggaaaacttctgttctgttaaatgtgttttgctcatagtgtggtagaatatcagcttactattgctttacgaaagcgtatccggtgaaataaagtcaacctttagttggttaatgttacaccaacaacgaaaccaacacgccaggcttattcctgtggagttatatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagggaatttcatgttcgggtgccccgtcgctaaaaactggacgcccggcgtgagtcatgctaacttagtgttgacttcgtattaaacataccttattaagtttgaatcttgtaatttccaacgcttcccgttttatcttaaatgcgaagtgaacagatttctggctcgtcactcaatccgtcttgtcgtttcagttctgcgtactctcctgtgaccaggcagcgaaaagacatgagtcgatgaccgtaaacaggcatggatgatcctgccataccattcacaacattaagttcgagatttaccccaagtttaagaactcacaccactatgaatcttaccgaattaaagaatacgccggtttctgagctgatcactctcggcgaaaatatggggctggaaaacctggctcgtatgcgtaagcaggacattatttttgccatcctgaagcagcacgcaaagagtggcgaagatatctttggtgatggcgtactggagatattgcaggatggatttggtttcctccgttccgcagacagctcctacctcgccggtcctgatgacatctacgtttcccctagccaaatccgccgtttcaacctccgcactggtgataccatctctggtaagattcgcccgccgaaagaaggtgaacgctattttgcgctgctgaaagttaacgaagttaacttcgacaaacctgaaaacgcccgcaacaaaatcctctttgagaacttaaccccgctgcacgcaaactctcgtctgcgtatggaacgtggtaacggttctactgaagatttaactgctcgcgtactggatctggcatcacctatcggtcgtggtcagcgtggtctgattgtggcaccgccgaaagccggtaaaaccatgctgctgcagaacattgctcagagcattgcttacaaccacccggattgtgtgctgatggttctgctgatcgacgaacgtccggaagaagtaaccgagatgcagcgtctggtaaaaggtgaagttgttgcttctacctttgacgaacccgcatctcgccacgttcaggttgcggaaatggtgatcgagaaggccaaacgcctggttgagcacaagaaagacgttatcattctgctcgactccatcactcgtctggcgcgcgcttacaacaccgttgttccggcgtcaggtaaagtgttgaccggtggtgtggatgccaacgccctgcatcgtccgaaacgcttctttggtgcggcgcgtaacgtggaagagggcggcagcctgaccattatcgcgacggcgcttatcgataccggttctaaaatggacgaagttatctacgaagagtttaaaggtacaggcaacatggaactgcacctctctcgtaagatcgctgaaaaacgcgtcttcccggctatcgactacaaccgttctggtacccgtaaagaagagctgctcacgactcaggaagaactgcagaaaatgtggatcctgcgcaaaatcattcacccgatgggcgaaatcgatgcaatggaattcctcattaataaactggcaatgaccaagaccaatgacgatttcttcgaaatgatgaaacgctcataaatttgtcttatgccaaaaacgccacgtgtttacgtggcgttttgcttttatatctgtaatcttaatgccgcgctggcgatgttaggaaaattcctggaatttgctggcatgttatgcaatttgcatatcaaatggttaatttttgcacaggactggtgggtttggaacggactttcccttctgaataaaggtcttcgtggttatacttctgctaataattttctctgagagcatgcattgtgaatttactgacagtgagtactgatctcatcagtatttttttattcacgacactgtttctgttttttgcccgtaaggtggcaaaaaaagtcggtttagtggataaaccaaacttccgcaaacgtcaccagggattgatacctctcgttggggggatttcggtttacgcagggatttgcttcacgttcggaattgtcgattactatattccgcatgcatctctctatctcgcttgtgccggtgtgcttgttttcattggcgcgctggatgaccgttttgatatcagcgtaaaaatccgtgccaccatacaggccgctgttggcattgttatgatggtgttcggcaagctttatctcagtagcctgggttatatctttggctcctgggagatggtgctcggaccgtttggttacttcctgacgctatttgccgtctgggcggccattaatgcgttcaacatggttgatggcattgatggcttgctgggcgggttgtcctgcgtctcgtttgcagcaatcggtatgattttgtggttcgacgggcaaaccagcctcgcaatctggtgctttgcgatgatcgccgccatcctgccatacatcatgcttaaccttggtatcctgggtcgccgctacaaagtctttatgggtgatgcgggcagtacgctgattggttttaccgttatctggatcctgctcgaaacgacccagggcaaaacccatcccatcagcccggttaccgctttgtggataatcgccattccgctaatggatatggtggcgattatgtaccgtcgcctgcgtaaaggcatgagcccattctctcctgaccgtcagcatattcaccatttgatcatgcgtgccgggtttacttcccgtcaggcgtttgtgctgattacccttgccgcagcactgctcgcttccattggcgtgctggcagaatattctcattttgtcccggagtgggtcatgctggtgctctttttgctagcattcttcctctatggatattgcattaagcgtgcctggaaagttgctcgctttattaagcgcgtaaaacgcagactgcgtagaaatcgtggtggcagccccaatttaaccaaataaatgaggatgtgatgacacaaccaatgcctgggaaaccggccgaagacgctgaaaatgaactggatattcgtgggttgtttcgtaccttgtgggctgggaagctatggattattggcatggggctggcgtttgcgttaatcgcgctggcgtatacgttttttgctcgtcaggagtggagctcgacggcgattaccgatcgtccaacggtgaatatgctggggggatattactcgcagcagcaatttttgcgtaacctggatgtccgttcaaacatggcttctgccgaccaaccatcggtcatggacgaagcctataaagagtttgttatgcaactggcctcgtgggatacccgcagagagttctggctgcaaaccgactattacaaacagcggatggtgggcaacagcaaagccgatgcggcgttgctggatgaaatgattaacaacatccagtttatccccggagactttacccgcgcggtcaatgacagcgtgaagcttattgccgaaaccgcgcctgacgctaataacctgttacgtcagtatgttgcttttgccagccagcgtgcagccagccatctgaatgatgagctgaaaggcgcatgggcggcgcgtaccatccagatgaaagctcaggtgaagcgtcaggaagaggtggcgaaagccatctacgaccgccggatgaacagcattgagcaggcgctgaaaattgctgagcagcataatatttcgcgcagtgcgacagatgtacctgccgaggaattacctgattcagaaatgttcctgcttgggcgtccaatgcttcaggctcgactggaaaatttacaggccgtcggtccggcctttgatctcgactatgatcagaatcgggccatgttaaacaccctgaatgttggtccaaccctggatccgcgttttcagacctatcgctatttgcgtacgccggaagaaccggtaaaacgcgatagcccacgtcgtgccttcctgatgattatgtggggcattgtcggggggctgatcggggctggtgtcgcattaacccgccgttgctcgaaatagcaacactgctgcggtgagcgcaaaggcgctcgccgcttattcgaagagaatcgatgtgaaagtactgactgtatttggtacgcgcccggaagccatcaagatggcgccgttggtgcatgcgttggcaaaagatcctttttttgaggctaaagtttgcgtcactgcgcagcatcgggagatgctcgatcaggtgctgaaactcttttccattgtacctgactacgatctcaacataatgcagccaggacagggcctgacagagataacctgtcggattctggaagggctaaaacctattcttgccgagttcaaaccagacgtcgtgctggttcacggcgatacgacgacgacgctggcaaccagcctggcggcgttttatcagcgtattcctgttggtcacgttgaggctggtctgcgcacgggcgatctctattcgccgtggccggaagaggctaaccgtacattgaccgggcatctggcgatgtatcacttctctccaaccgaaacttcccggcaaaacttgctgcgtgaaaacgttgcggatagccgaatcttcattaccggtaatacagtcattgatgcactgttatgggtgcgtgaccaggtgatgagcagcgacaagctgcgttcagaactggcggcaaattacccgtttatcgaccccgataaaaagatgattctggtgaccggtcacaggcgtgagagtttcggtcgtggctttgaagaaatctgccacgcgctggcagacatcgccaccacgcaccaggacatccagattgtctatccggtgcatctcaacccgaacgtcagagaaccggtcaatcgcattctggggcatgtgaaaaatgtcattctgatcgatccccaggagtatttaccgtttgtctggctgatgaaccacgcctggctgattttgaccgactcaggcggcattcaggaagaagcgccttcgctggggaaacctgtgctggtgatgcgcgataccactgagcgtccggaagcggtgacggcgggtacggtgcgtctggtaggcacggataagcagcgaattgtcgaggaagtgacgcgtcttttaaaagacgaaaacgaatatcaagctatgagccgcgcccataacccgtatggtgatggtcaggcatgctctcgcattctggaagcgttaaaaaataatcggatatcactatgagttttgcgaccatttctgttatcggactgggttatatcgggctgccaacggcagcagcgtttgcctcacggcaaaaacaggtaattggtgtcgatatcaaccaacatgcggttgataccatcaatcgtggcgaaatccatatcgtcgaacctgatttggcgagtgtagtaaaaactgccgtagaaggcggttttttacgagcgagcacgacgccagttgaagcggatgcctggctgattgctgtacccacgccgtttaagggcgatcatgagccagatatgacctacgttgaatcggctgctcgctccattgcgccagtgctgaaaaaaggcgcgctggtgatccttgaatccacctcgccggtggggtcaaccgagaagatggcagaatggttagcagagatgcgtccggatctcactttcccgcagcaggtgggcgagcaggcggacgtcaacattgcttactgcccggaacgcgtgttaccaggacaggtaatggtcgagctgattaaaaacgatcgcgtgattggtggtatgacgccggtttgttcggcccgcgccagcgaactgtacaaaattttcctcgaaggtgagtgtgtcgtcactaactcgcggacggcggaaatgtgtaagctcaccgaaaacagcttccgcgatgtgaatatcgcttttgctaatgaattgtcgctgatttgtgccgatcaggggattaacgtctgggaactgattcgcctggcgaatcgtcaccctcgcgttaatattcttcagcctggccctggcgtgggcggtcactgcattgctgttgatccgtggtttatcgtggcacagaacccccagcaggcgcggcttatccgtaccgcgcgcgaagtgaacgatcacaaaccgttctgggttatcgatcaggtgaaagcggcggtggctgattgcctggcggctaccgataaacgcgccagtgaactgaaaatcgcctgctttggtctggcgtttaaaccgaatattgatgacctgcgcgaaagcccggcgatggaaatcgctgaactgatcgcccagtggcatagcggcgaaactctggttgttgagcctaacatccaccagttgccgaaaaaactgaccgggctttgtactctggcgcagcttgacgaggcgctggcaacggcagacgtgctggtgatgctggtcgatcatagtcagttcaaagttatcaatggcgacaatgtccatcagcagtatgtcgtcgatgccaaaggagtctggcgctgatgagaaaaattctgataacaggtggtgccgggtttattggctcggcgctggtgcgttatatcatcaacgaaacgagcgacgcggtggtagtggtcgataagctgacctacgccggaaacctgatgtcgctggcaccggtcgcgcaaagcgagcgctttgcctttgagaaagttgatatctgcgatcgggcagaactggcacgcgtattcactgagcatcagccagactgtgtcatgcatctggcagccgaaagccatgttgaccgttctattgacggcccggcagcgtttattgaaaccaacattgtcgggacttatacattgcttgaagcggcgcgggcttactggaatgcgctgacggaagataaaaaatcagcgttccgttttcatcatatctccactgacgaagtatatggtgacctgcactcgacggatgatttcttcaccgaaaccacgccgtatgcgccgagcagcccttattccgcgtcaaaagccagcagcgaccatctggtgcgcgcctggctgcggacctatggtctgccgacgcttatcaccaactgctcgaataactacggcccttaccactttccggaaaaactgatcccgctgatgatcctcaacgcgctggcgggtaaatcgctgccggtatatggcaacgggcagcaaatccgtgactggctgtatgtggaagatcacgcccgcgcgctgtattgcgtggcgaccaccgggaaagtcggtgaaacctataatattggtggtcacaacgagcgtaagaatctcgatgttgtggaaaccatttgcgagctgctggaagaactggctccgaacaagccgcacggcgtggcgcactatcgtgacctgatcacctttgtcgctgaccgtccggggcatgatctgcgttatgccattgatgcttcgaaaattgcccgtgaacttggctggctgccgcaggaaacctttgaaagtggaatgcgtaaaacggttcagtggtatctggctaatgaaagctggtggaagcaggtgcaggacggcagctatcagggcgagcgtttaggtctgaaaggctaattttcagcggaggcaaacatgaaaggtattatcctggcgggcggttccggcacccgattgcatccgattacgcgcggcgtatcgaagcaactgttgccgatttacgataagccaatgatttactatccgctgtcggtgctgatgctggccggtatccgcgaaattctcatcatcactacgccggaagataaaggttatttccagcgcctgctgggcgatggtagtgagttcggtatccagctggaatatgccgaacagcccagcccggacggtctggcgcaggcctttatcatcggtgaaaccttccttaatggtgaaccttcttgtctggtgctgggcgataacatcttcttcggtcagggcttcagtccgaagctgcgtcatgttgcggcgcgcaccgaaggggcgacggtttttggctatcaggtgatggacccggaacgctttggcgtggtggagtttgacgacaatttccgcgctatctcgctggaagaaaagccaaaacagccgaagtcaaactgggcggtgaccgggctttatttctacgacagtaaagtcgtggagtacgcaaagcaggtgaagccgtcggagcgtggtgaactggagattacctccatcaaccagatgtacctcgaggcgggcaacctgaccgttgaactgctcgggcgcggatttgcctggctggataccggcactcacgacagcctgattgaagccagcacctttgtacagacggtggaaaaacgccagggctttaagattgcctgcctggaagagattgcctggcgtaacggctggctcgatgacgagggtgtgaagcgtgctgccagttcattagcgaaaactggctacggccaatatctgctggagttacttcgtgcccgtccgcgccagtattgagccactaacctgggaaaacgccttctttggtgttaacagcgccatcgtgcgcattacgtctgaagcaccgctcctgacgccagacgcgttagcgccgtggtcacgggtgcaggccaaaattgcggcatcaaatacgggtgaactggatgccctgcaacagctgggattctccctggtagaaggtgaagttgatttggcgctacccgtgaacaatgccagtgatagcggtgctgtagtggcacaagagaccgatattcccgcattacgtcagttagccagcgccgcatttgcgcaaagccgttttcgtgcgccgtggtatgcgcctgacgccagcagtcgcttttatgcacagtggattgaaaatgccgtgcgcggcacctttgatcatcaatgtctgattttacgtgcggcgtccggcgatattcgcggctatgtctctttacgggaactcaatgcgacagatgcgcgaattggcctgctggctggacgcggtgcaggtgctgagctgatgcaaacggcgctaaactgggcgtatgctcgcggtaaaacaactttgcgggtggcgacccaaatgggcaacaccgccgcgcttaaacgatacatacaaagtggtgcgaatgtagaaagcaccgcgtactggttatacaggtgatcacatgattccatttaacgcaccgccggtggtgggaaccgaactcgactatatgcagtcggcaatgggtagcggcaaactgtgtggcgatggcggttttacccgtcgctgccagcagtggctggagcaacgttttggcagcgccaaagtgttactgacgccgtcctgcaccgcttcgctggagatggcggcgctgctgctcgatatccagcctggcgatgaagtgatcatgccgagctacacctttgtctccaccgccaatgcctttgtgctgcgtggcgcaaaaatcgtttttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaaaaagcataatttgtttgtggtagaagatgccgctcagggcgtgatgtccacttacaaagggcgtgcactgggaaccattggtcatattggctgctttagcttccatgaaaccaaaaactacacggcgggcggtgaaggcggcgcgacgctgattaacgataaagcgttaatcgaacgagccgagatcatccgtgaaaagggcactaaccgcagccagttcttccgtggtcaggtcgataaatatacctggcgcgatattggctccagctatttgatgtccgatctgcaagctgcatacctgtgggcgcaactggaagcagcggatcgtatcaaccagcaacgtctggcgctgtggcaaaactactacgatgcgttagcgcctctggcgaaagccgggcgtatcgagctgccgtcgattcccgatggctgcgtgcagaacgcgcatatgttctacattaaactgcgggatattgatgaccggagcgcgttgattaactttctgaaagaagcggaaatcatggcggtgtttcattacattccgctgcacggttgccctgcgggggaacactttggtgagttccacggtgaagatcgctacaccaccaaagagagcgagcgcctgctgcgcctgccgctgttctacaacctgtcgcccgtcaatcagcgtacggtaattgcgactttgttgaactacttttcctgatatgtcgttggcaaaagcgtccttgtggacggcggccagtacactggtcaagattggtgccgggttactggtcggtaagttgctggcggtgtcatttggtccggcggggcttgggctggcggcaaatttccgccagttgattaccgtgctcggcgtgcttgccggggctggcatctttaacggtgtaaccaaatacgttgcccagtaccatgataatccgcaacagctgcgccgcgtggtcggcacttcatcagcgatggtacttggtttctctacgctgatggcgctggtttttgtgctggcagctgcgccaatcagccagggattgtttggtaataccgactatcaggggctggtgcgtttagtggcgctggtgcaaatggggatcgcctggggcaacctgttactggcgctgatgaaaggctttcgcgatgccgcaggtaatgcgttatcgctgattgtcggcagcttgattggcgttctcgcgtactacgtcagttaccgtttgggcggttatgaaggggcgttgctgggtctggcgctgattcccgcgctggtggtaattcctgccgccatcatgttgatcaaacgtggtgtcatcccgttaagctatctgaaacccagctgggataacggtctggcagggcagttgagcaaatttacgctcatggcgttgattacgtcggtgaccttgcctgttgcttacatcatgatgcgtaaactgctggcggcgcagtatagctgggatgaggtggggatctggcaaggggtgagcagtatttccgatgcctacctgcaatttattacggcatcgttcagcgtatatttgctgcccacgttgtcgcggctaacggaaaagcgcgatatcacccgggaagtggttaaatcgctgaaattcgtcttaccggcagtggcggcggcgagttttaccgtctggctgctgcgtgattttgctatctggctgctgttgtcgaataaatttaccgctatgcgcgatctctttgcctggcagttagtgggtgatgtgttaaaagtgggcgcttatgtctttggttatctggtgatcgccaaagcgtcactgcggttttatattctggcggaagtcagccagttcactttattgatggtatttgcccactggctaatccctgcgcatggtgcactgggcgcggcgcaggcatatatggcaacttatatcgtctatttttctctttgttgtggcgtgtttttactctggcgtaggcgggcatgactgtactgattcacgtactgggatcggatatccctcaccataaccgaaccgttttgcggtttttcaatgacgcgctggccgcgacgagcgagcacgcgcgcgagtttatggttgttggcaaggacgacggcttaagtgatagctgtccggcgctttctgtgcaatttttccctgggaaaaaatcgctggcggaagcggtcatcgcgaaagcaaaagctaaccgtcagcagcgttttttcttccacggtcagttcaatcccacactgtggctggctctgctgagtggtggcattaagcccagccagtttttctggcatatctggggggcagacctgtatgagctttccagtggcttgagatataagcttttttacccactacgtcgcctggcgcaaaagcgagtcggctgtgtatttgccacccgcggcgatttgagcttttttgccaaaacgcacccaaaggtgcggggcgaactgctgttcttcccgacgcggatggacccttcgctcaatacgatggcgaacgatcggcaacgtgaagggaaaatgaccattctggtggggaactccggcgaccgcagcaatgagcatattgctgccttgcgcgccgttcatcagcaatttggcgatacggtaaaagtggtggtgccgatgggatatccgcctaataacgaagcgtacattgaggaagttcgtcaggcggggctggagttattcagcgaagaaaatctacaaattctgagcgaaaaactggaatttgacgcctatctggcgctacttcgtcagtgcgatcttggttactttatttttgcccgccagcagggcattggtacgctgtgcttactgattcaggcgggcattccttgtgtgcttaaccgggaaaatccgttctggcaggatatgacggaacaacatttgccggtgctgtttactaccgacgatctcaacgaggatattgtgcgtgaagcgcagcgccagttggcgtcggtggataaaaacaccattgccttctttagccctaactatctacaaggctggcagcgggcgttggcgattgccgccagggaggtcgcatgagtctgctgcaattcagtggcctgtttgttgtctggctgctctgcacgctgtttattgccacgctgacctggtttgagtttcgccgtgtgcgctttaacttcaatgtcttcttttcattgctgtttttgctcacctttttcttcggcttcccgctgaccagcgtgctggtatttcgctttgatgttggtgtcgcgccgccagaaatcttgttgcaggcgttgctttctgcgggctgcttctacgcggtttactatgtcacctacaaaacccgcctacgcaaacgcgttgctgatgtaccgcgccgtccgctgtttaccatgaaccgcgtggagaccaatcttacgtgggtgatcctgatgggtatcgcgctggtaagcgtcggcatcttcttcatgcacaacggctttttgctgttccggcttaactcctacagtcagatcttttccagtgaagtctccggcgtggcgttaaaacgcttcttttactttttcatcccggcgatgctggtggtctactttctgcgccaggacagcaaagcgtggctgtttttcctcgtcagcacggtcgcctttggcttgctgacttatatgattgtcggcggcactcgcgccaatatcatcatcgcattcgctatcttcctgtttattggcattattcgcggctggatttcgttgtggatgctggcggcggcgggcgtgctggggattgttggcatgttctggctggcactaaaacgctatggaatgaatgtgagcggcgatgaagcgttctatacgtttctctatctcactcgcgacaccttctcgccgtgggagaatctggcgttgctgttgcagaactacgacaacatcgacttccagggcctggctccaattgtccgcgatttctatgtctttatcccttcctggctgtggccgggtcgcccgagtatggtgctgaactcagccaactactttacctgggaagtgctgaataaccactccggactggcgatctcgcctacgcttataggctcactggtggtgatgggcggcgcgttgttcatcccgctcggggcgatcgtggttggtctgatcatcaaatggttcgactggctgtatgagctgggcaaccgcgagcctaatcgctataaagctgcgatattgcacagtttctgctttggggcgatcttcaatatgatcgtgctggcgcgtgaagggctggattcgtttgtctcacgcgtggtcttttttatcgtggtcttcggcgcatgtctgatgatcgcaaaactgttgtactggctttttgaaagcgccggactcattcataaacgtacaaaatcatcgctccggacgcaggttgaaggataacaatgaataacaacaccacggcaccaacctatacgctgcgtggcttacagttgattggttggcgtgatatgcagcacgccctcgattatctgtttgctgacgggcagcttaagcagggaacgctggttgccattaatgctgaaaaaatgctgactattgaagataacgccgaggtcagggagttaattaacgctgccgaatttaaatatgcggatggcatcagcgttgtacgttcagtacgtaaaaagtacccgcaggcgcaggtttcccgcgttgccggtgccgatctctgggaagagctgatggcgcgcgcaggcaaagaagggacgccggtatttcttgtgggcggtaaacctgaagtgctggcgcaaactgaagctaaactgcgcaaccagtggaatgtgaatatcgttggcagtcaggatggttattttaaacccgagcagcgtcaggcgctgtttgaacgcattcatgccagcggtgcgcaaatcgtcaccgttgcgatgggatcgccaaagcaggagatcatcatgcgcgactgccgtctggtacatccagatgcgctgtatatgggcgttggcgggacttacgatgttttcaccggtcacgtaaaacgcgcaccgaaaatctggcaaacgctggggctggagtggctctaccgcctgctttcgcagccgagccgcattaagcgtcagcttcgtttgctgcgttatttacgctggcactacaccggcaacctatgattttcctctctttgtaaagcgacggagtggtcactccgtcgcctgtctgcttttttattacacaaagcattcaaatttttaatgctttatttgccatttctcctgaattacgaaaacatttgcaacactcgatgtacccataacgataaccggtaacaccggaaagcatgcaaacacaacacgaggatttatggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgttcctcgaaccggttaccggttcgttcgccgtttatgcgcatcgttatatgagcccgttctttggctatctcaccgcctggtcttactggtttatgtggatggcggtggggatctctgaaatcaccgccattggcgtttatgtccagttctggttcccggagatggcgcagtggatacccgcattgatcgcagtggcgctggtggcgttggcgaatctggcggcggtgcggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgcgggtggctggaaagggttcctgaccgctctgtgtattgtggtggcgtcctaccagggcgtggagctgattggcattactgccggtgaagcgaagaatccgcaggtgacgctgcgcagtgccgtaggcaaggtgctgtggcggatcctgattttctacgtaggcgcgattttcgttatcgtcaccatcttcccgtggaatgaaataggcagcaacggcagcccgttcgtactgacttttgccaaaatcggtattaccgcagcggcgggcattatcaactttgtggtgctgacggctgcgctctctggctgtaacagcggcatgtacagttgcggacgtatgctctacgcactggcgaaaaaccgtcagttaccggcggcaatggcgaaagtttcccgtcacggcgtaccggttgcgggtgtggcagtatctattgctattctgctaattggctcatgcctgaactacatcattcccaatccgcagcgtgtgtttgtctacgtctacagtgccagcgtgcttccggggatggtgccatggtttgtgatattgataagccagctgcgttttcggcgtgcacataaagcggcgattgccagccatccgttccgctcaatcctgttcccgtgggccaattacgtaacaatggcattcctgatttgcgttttgatcggcatgtactttaatgaagatacgcgtatgtcgctgtttgttggcatcatctttatgctggcggtgacggcgatttataaagtttttggccttaatcgccacgggaaagcgcataaactggaggaataagcagcaaaacgcacaaaccgtaaccaaacgcgcaatttatttaaaaagggactagacagaggggtgggaagtccgtattatccacccccgcaacggcgctaagcgcccgtagctcagctggatagagcgctgccctccggaggcagaggtctcaggttcgaatcctgtcgggcgcgccatttagtcccggcgcttgagctgcggtggtagtaataccgcgtaacaagatttgtagtggtggctatagctcagttggtagagccctggattgtgattccagttgtcgtgggttcgaatcccattagccaccccattattagaagttgtgacaatgcgaaggtggcggaattggtagacgcgctagcttcaggtgttagtgtccttacggacgtgggggttcaagtcccccccctcgcaccacgactttaaagaattgaactaaaaattcaaaaagcagtatttcggcgagtagcgcagcttggtagcgcaactggtttgggaccagtgggtcggaggttcgaatcctctctcgccgaccaattttgaaccccgcttcggcggggttttttgttttctgtgcatttcgtcaccctcccttcgcaataaacgcccgtaataactcattgccccacggtatgatttcgcccttaacgtattgaaggatgacttcaggcaaggagcgaccatgctgcaacaggttccaacgcgtgcttttcatgtgatggcgaaaccgagcggttccgattgtaatctgaactgtgactactgtttttatctcgaaaaacaatccctttaccgcgaaaagccagtcacgcatatggacgatgacacgctggaagcgtatgtccgtcactatatcgctgccagcgaaccgcaaaacgaagtggcttttacctggcagggcggcgaaccaacgctactcgggctggcgttttaccgccgtgccgtagcgctacaggcgaaatatggtgctggcaggaagataagtaacagcttccagactaacggcgtgctgctggatgacgaatggtgcgcgtttctcgcggagcatcattttcttgttggtttatcgctggatggcccgcctgagatccacaatcaatatcgcgtgactaaaggtggcagacccacgcataagctggtgatgcgtgccctgacgctcctgcaaaaacatcatgtcgactataacgtgctggtctgcgttaatcgcaccagcgcgcagcaaccgttgcaggtatatgattttttgtgcgatgcgggagtcgaattcatccagtttattccggtggtcgagcgcctggctgatgaaacaactgcccgcgatggacttaagttacatgcgcctggtgatattcagggtgagctaacggaatggtcggtgcgccccgaggagttcggtgagtttctggtggcgatattcgaccactggatcaaacgcgacgtcggcaagattttcgtgatgaatatcgaatgggcgtttgccaattttgtcggtgcgccgggtgcggtttgccatcatcagccaacctgtgggcgctcggtgattgttgagcacaacggcgacgtttacgcctgtgatcactatgtttatccgcaatatcggctggggaatatgcaccagcaaacaattgcagaaatgatcgattccccgcaacagcaggcgtttggtgaagataaatttaagcagttaccggcgcagtgtcgcagttgtaacgtgttaaaagcgtgctggggaggctgcccgaaacaccgcttcatgctcgatgccagcggcaaaccgggactgaattatttgtgtgccgggtatcagcgttatttccgccatctaccgccatatcttaaagcaatggctgatttgctggcgcacggtcgcccggccagcgacattatgcatgcgcatttgctggtggtgagtaagtagaaatcggcggccgcctgcggttgattgccggatgcggcgtaaacgccttatccggcctacatgatcgtgcaaattcaataaattgcagcgttctgtaggctggataagatgcgtcagcatcgcatccggcaaaggcagatctcagcgatagcgccggcttagtcagatttaatctgcgcgcgtggtggatattttttcaggatctccatatacgcgtgcatttcggtctgtagcggtacacccatcggaatatggcgcacgccgatggagtcgctttcctgcggatcggtgtagaggttaaacaccgacgatcccgccgtttgcattactgtgccggtgaatccaccctgatatccgctctgggtataagcgtaaggttgctgaatcaggacgtgatacttgaactcatccatacgcacagcagcgagtttaccgttgaggaagtagtgctcggccttacggttagactgaccatttgttcccaggaagaaggatgtctggtccacaccatcgataaaggtggttttcggcactaaattcgccactttcgctccaggatgccctgccagatccagcgcggtagggaagagatctgccagatcgacaataccgtcagatttacgcggttggatcatccctttccagtaaacgaaagtcggtacgcgaacgccgccttcccaggtcgaacctttcgcaccacggaacggggtgcgtccgtgcggcggtacttcggcttccggtccgttatcggaggtaaagacgatcagcgtgttatcaagctgaccgtttttctccagtgttttatacagattagcgaacacatcgttcatctccaccatgcagtcgccatacgaggtgcgtgccggagagctacccgcatatttcgcatttgggtagttatcgaagtggcagccacgagtgccgtagtagaggaagaatggtttatcgctcttcgccatcttgtcgaggaacttaacgccatagtccatccagcgttgatccagatcttccatatatttcggcgtaatgtcggcaatggcctgttgttcgccgccgcgcaccgcatgaacgtcatctttgctgaacggtaattgcttgatgtattcagaacggtccggactcagggccacttccggattgacgtgaacgtcgcgccattcggtgtacatatcagacaccgagttaaagccacggaaatcatcaaagccaacgttctgcggctgcgactctttgttttcccccatatgccattttccgatggcctgagtgacgtagccctgatcgtgcagcaactgcggcagcgtggttaacccttgcagcccgcccggttgcccgtacattggcggcatcagaatgccgtggtggatggagtattgtccggtgagaatggtggcgcgggttggggaagagcttggttgagaatacgccgaagttaaaatcagcccctggctggcaacggcgtcgatatctggtgtagggttacccaccgccacgccgccaccgttaaaaccgacgtccatccagcccacatcgtccagcaagaaaacaaccacattcggtttcttaccggtttttttctcaagttctgccagcttctgctgggtttctttatcctgcgccggatgctgcattactggcatcatattgtcggcaatagtggtcgccggtttaaccagatactggtttgggtgatcgtatccggcaaagcctttgcgtgcggtggcagttgacggggtatctgctgcgctggccatgagaggaagagcggcggcgacagcaacaacaagacgtttgggtgaaaacgaaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtaaggcaggtttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcccgattctctgtggcataataaacgagtagatgctcattccatctcttatgttcgccttagtgcctcataaactccggaatgacgcagagccgtttacggtgcttatcgtccactgacagatgtcgcttatgcctcatcagacaccatggacacaacgttgagtgaagcacccacttgttgtcatacagacctgttttaacgcctgctccgtaataagagcaggcgtttttttatgtatcaggaaggccccggaggtgcttgcctccgggtgagaaggaactactgtggcgggttattctgcaacgttaacatcaaaccgtcgcgacgcatagctgcagcttcttccggcttgtgcagtctgtccagcgcgtcggcaagccatgcgtaatcgtaggcgtccggacgttgtttcagcgctgcgcggaaggcgagcgatgcttcctgccattctccgtgcttcatcagtgactggcccagtgtgctccacaacagcgggcgatcgccgacgtttttgatttgctggcgcagcactttttccagctgttccggattgtttgttttcagtcgaggaatcggcagcagtaggcgatcgtcgtactggcgtttcaggccatcgatgataatttgctgggcagtatcatgatcgtcacattcaataagatgttccgccattgccacctgcaacgctacctgatgacgcgttttccggctttggtttttccaccagttacgcaaaccttcgctaccgttatcggcacgcgcctgatccatcaggccaatccatgcctgttgttccagcattgcacgatgttcttcatcaccaacatgggctttcgccattgatgggataatatccagcagcgaactccatgcacctgtgcggatatacgcctgttccgccagacgtaatacttccggatggcgtggcgtaacttccagcagcttatccacgccgtggcgtgcagcatggttttcattacgggccagttgcagacgtacgcgggtgatttctaccggaatggtgtcgttgccggccagctccgctgcgcgttccagatgttggttggcgcgtgcttcatcaccacgttgttgcgcggcttcggcagccagtagatagttcaccaccggttgttccgcgtgatcggcatttttcgccatcagcttttcaacttgctgataatcgccttccgccagtttcagcagcgcctgttcggtctgcttacgtgcacggcgacgcttacgtccgacaaaccacccacgggtgtgcgcgccagtgcggaagatccgccgcagtagccactcaatggcaaacagcactaccatcgccagaatcaatatgatcgccaggcccgtgacgctggtttcgatattgtagttgtcggtctggatcagcacataaccctgatggccggcaatcatcgggccaaccacgatccccgcaatcagcaacacaaagagcaataacacttttagcatggttattctccttgcggcgcggctgccggagtatcagcttgcggtgcaggtgcaggtttagcttccgttgtccccgctgccggttgtgccagcaggttacgcacgcgagtctgcatcagtttttccagcatcgcctggctttgcagggtttccggaagatccatcgagatattttgctggcttaactggtccacctcgtcgaggaacgctttggtggtggcatcatcagtatcgtagtaagcacgtacccaggtggagacgttctccagcgcctggcgataagtctcttcctggtgacgcggtacagcttgtgctgcgaccagcaggcgagagcgaatattttcgcgcagatagatatcctgatttggcgctaacagcggtacggcggtgtcatcacgacggcgaatcgtaatgaagttgtccataaagttctgccagcttttttgcagattgatacgccattcgctgatggaactggaaagctcttcaccgtctgaatccatcggcgaaccatcgctgtcattatcggccagacgcaggttatctacctgatttgaaagctgattaagcttaaggatgatgccgtcataatccacctgcgatactgcagaaaggctggcgatatcatcggtaattgcccgacgaacggtaatcagactcgggtcattcatatccgccaggctggcgtctgcacttttcagcaacgctgcagcggtcgtgacgtcctgatcgctccacagcttccgtccggcgagtttcaccagaaaatcggcctgagccagcagccaggttttagcatcgctgccggaaatggtggcgaccttttgttggacttcatccaactgttttgccagcgtttcttgctgacgattcgcctgcttaagttgtgcagcttgttgcttaataatgccttccagctcggctttttggctctcctgggctttttgcaatgccgtcagttggttagccagggcatcgctggtggcggtctgattgacggcctgttgtttaccccagccatacaaaccgatgcccgccgccagagcaatagcgatagccaccgcgctgagaatcaatgcggtattgttcttactctttttttctgttgcgacaggttgtgacgtggtgtccacggcctccctggtctcttcaaccacggcggaggttttttcttgttccgtcattatggcttcctgttatgagagttattgtaatgcccgtaaaagcgcatcgttgtcagcgttatcggcgaccttaatgtcttgccagcccagttcccgggcgagtttcgccaaacgctcactgacgaccaatagtcgacagtgtagtaaccagtgctcacgataccattgtgggatcagcgaccagagttgctgcaacatttcaccgctggtaacaacgaccatcgtcacctcgcgggcttgccagcgcatcgcttcttctgcaccatcgtaatggattgcgcatcgttgataacattcacaaaaagtgacctcagcaccgcgcgccgtcagggtatccccaattagctcacgaccaccattgccacgtaatatcagcgcacgtttgcccgcaatattttgtaattcaggtaattgtagcaagacttcgctgatttcccgatcctgcgggtagagaatcttctgtccacttacggtatgtagtgccagtgcggtggtgcgtccaatggcgaaataatcaggtagtcggggccatttacgatcttgctgatgcagctgtgattgggcaaaagcaaccgcgtgttgcgagagggcaaacaacagatcgctctcccccagcgctgccagttgatcagcaagttgcggtaattgttgacccggagaaaactcaatcagcggaaaatgccaggccacctgccccagtgtgcgcagacggctcactaactcttctccagcgggagacgggcgggtgacaaggatactcatgccggggcgtctccgttatagacttcagcgaggatctcgcgcgcgccgttattcagtagctcttctgccagcgaaatccccatttgttcggcatcttgcggcgcaccgcggcgttcaccgcgaataatctgcgaaccgtccggcgcgccgaccagcgcacgcagccagatttcgccatcaataagctcggcgtagctaccaattggcacctgacatccgccttcgagacgggtattcatggcgcgttctgcggtaacgcgcagtgcagtttcgtggtgattcagcgcggcaagcagctcgcgagtgcgtgaatcatcaaggcggcattcaatacccaccgcaccttgtcctaccgccggaagagaaatctcgggtggcaacgcggcgcgaatacgtgactccagacctaaacgttttagtccggctacggcaagaatgatggcatcgtattcgccgttatccagtttgctcaggcgagtgccgacgttgccgcgcagggagcggataatcagatccggacggcgttcagccagttggcactggcgacgtaaactggacgtcccgacgatactgcctgccggtaacgcatccagactgtcatagttattggacacaaaggcatcgcgaggatcttcacgctcacaaatagtgaccagtcccagaccttgcgggaattcaaccggcacatctttcattgagtgtacggcgatatcggcgcgattttcgaggagcgcgacttccagctcttttacaaataagccttttccgcctactttcgccagcggcgtatcaagaatcacatcgccgcgcgtcaccatcggtaccagttcaacgaccaggcccggatggctcgccatcaacttgtctttgacatagtgtgcctgccagagtgcaagtgggctttggcgtgtggcaattcttaaaacattgtctaacatgcttgttaccgtcattatcatccgtggtccatcctaacatccttgccagagtgatgtcagtgttgtggtgaaacgtagacgcctgcgcaaaccgtaaaatgaggtctggcagtggatcctgacaggcgtttcacgccgttgtaataaggaatttacagagaataaacggtgctacacttgtatgtagcgcatctttctttacggtcaatcagcaaggtgttaaattgatcacgttttagaccattttttcgtcgtgaaactaaaaaaaccaggcgcgaaaagtggtaacggttacctttgacatacgaaatatcccgaatgccgcgtgttaccgttgatgttggcggaatcacagtcatgacgggtagcaaatcaggcgatacgtcttgtacctctatattgagactctgaaacagagactggatgccataaatcaattgcgtgtggatcgcgcgcttgctgctatggggcctgcattccaacaggtctacagtctactgccgacattgttgcactatcaccatccgctaatgccgggttaccttgatggtaacgttcccaaaggcatttgcctttacacgcctgatgaaactcaacgccactacctgaacgagcttgaactgtatcgtggaatgtcagtacaggatccgccgaaaggtgagcttccaattactggtgtatacaccatgggcagcacctcgtccgtagggcaaagttgttcctctgacctggatatctgggtctgtcatcaatcctggctcgatagcgaagagcgccaattgctacaacgtaaatgtagcctgctggaaaactgggccgcctcgctgggtgtggaagtcagcttcttcctgattgatgaaaaccgcttccgtcataatgaaagcggcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgctgacgccaaatgaatggctggatctcggtggcttaagctcgctttctgctgaagagtactttggtgccagcctttggcagctctacaagagtatcgattccccatacaaagcggtactgaaaacactgctgctggaagcctattcctgggaatacccgaacccacgtctgctggcgaaagatatcaaacagcgtttgcacgacggcgagattgtatcgtttggtctcgatccatactgcatgatgctggagcgtgttactgaatacctgacggcgattgaagattttacccgtctggatttagtacgtcgctgcttctatttaaaagtgtgcgaaaagctcagccgtgaacgcgcctgcgtaggctggcgtcgcgcagtgttgagccagttagtgagcgagtggggttgggacgaagctcgtctggcaatgctcgataaccgcgctaactggaagattgatcaggtgcgtgaggcgcacaacgagttgctcgacgcgatgatgcagagctaccgtaatctgatccgctttgcgcgtcgcaataaccttagcgtctccgccagtccgcaggatatcggcgtgctgacgcgtaagctgtatgccgcgtttgaagcattaccaggtaaagtgacgctggtaaacccgcagatttcacccgatctctcggaaccgaatctgacctttatttatgtgccgccgggccgggctaaccgttcaggttggtatctgtataaccgcgcgccaaatattgagtcgatcatcagccatcagccgctggaatataaccgttacctgaataaactggtggcgtgggcatggtttaacggcctgctgacctcgcgcacccgtttgtatattaaaggtaacggcattgtcgatttgcctaagttgcaggagatggtcgccgacgtgtcgcaccatttcccgctgcgcttacctgcaccgacaccgaaggcgctctacagcccgtgtgagatccgccatctggcgattatcgttaacctggaatatgacccgacagcggcgttccgcaatcaggtggtgcatttcgatttccgtaagctggatgtcttcagctttggcgagaatcaaaattgcctggtaggtagcgttgacctgctgtaccgcaactcgtggaacgaagtgcgtacgctgcacttcaacggcgagcaatcgatgatcgaagccctgaaaactattctcggcaaaatgcatcaggacgccgcaccgccagatagcgtggaagtcttctgttatagccagcatctgcgcggcttaattcgtactcgcgtgcagcaactggtttctgagtgtattgaattgcgtctttccagcacccgccaggaaaccgggcgtttcaaggcgctgcgcgtttctggtcaaacctgggggttgttcttcgaacgcctgaatgtatcggtacagaaactggaaaacgccatcgagttttatggcgcgatttcgcataacaaactgcacggcctgtcagtgcaggttgaaaccaatcacgtcaaattaccggcggtggtggacggctttgccagcgaagggatcatccagttctttttcgaagaaacgcaagacgagaatggctttaatatctacattctcgacgaaagcaaccgggttgaggtatatcaccactgcgaaggcagcaaagaggagctggtacgtgacgtcagtcgcttctactcgtcatcgcatgaccgttttacctacggctcaagcttcatcaacttcaacctgccgcagttctatcagattgtgaaggttgatggtcgtgaacaggtgattccgttccgcacaaaatctatcggtaacatgccgcctgccaatcaggatcacgatacgccgctattacagcaatatttttcgtgatgaacgtgccggaaagcgaggcttatccggcatgcaatcttagcggaaactgactgtttcacccgcctgctgcgtcgccgcctgttccagcaaatcccagaaggtttcgccgctgcgatcacaaatccactcatcgcctttcaggtcaaaatggtagccgccctgtttggttgccagccatacctggtgcagcggctcctggcggttgataatgattttgctgccattctcaaaggtaatggtcagtacgccgccgttgatttcgcagtcgatatcgctgtcgccatcccagtcgtccaggcgttcttcaatggtcagccagagttgatcagccaggcgatgaaattcactgtcgttcattgttgtatcctgtttttaagtgatggcggcagtatagcggcatggggtcagggcttcaaagtttgcacctctgcggctgcgttccggcacgattcatccgtcaccggaataatgatgtctctgtgtagcgaaagatttgtctcttcattagggcgcagttacaccacgtctttccctgtttctggtaaacattatgatcaggtttaccgagcgagcatcctcacgctgacggaactaaaaaagacaacaaacaaaccacattgcgatagtgcataaagccatcctggcgcgaggtgccgatcacgaaactaccagcaaaacataaatccccacgagtaagcgttatactcgcagcatttcctcacttttcagacttcataaagagtcgctaaacgcttgcttttacgtcttctcctgcgatgatagaaagcagaaagcgatgaactttacaggcaatccataatgaaaaacgtgtttaaggcactcactgtattacttactctcttcagcctgacgggctgcggtctgaaaggtccgctctatttcccgcctgcagataaaaacgcaccgccgccgaccaaaccggtagagacgcaaacgcaatccacggtgccggataaaaacgatcgcgccactggcgatggtccatcccaggtgaattactaaaagtcagtttctgtacccgcgtgattggagtaaatgatgcagttctcgaaaatgcatggccttggcaacgattttatggtcgtcgacgcggtaacgcagaatgtctttttttcaccggagctgattcgtcgcctggctgatcggcacctgggggtagggtttgaccaactgctggtggttgagccgccgtatgatcctgaactggattttcactatcgcattttcaatgctgatggcagtgaagtggcgcagtgcggcaacggtgcgcgctgctttgcccgttttgtgcgtctgaaaggactgaccaataagcgtgatatccgcgtcagcaccgccaacgggcggatggttctgaccgtcaccgatgatgatctggtccgcgtaaatatgggcgaacccaacttcgaaccttccgccgtgccgtttcgcgctaacaaagcggaaaagacctatattatgcgcgccgccgagcagacaatcttatgcggcgtggtgtcgatgggaaatccgcattgcgtgattcaggtcgatgatgtcgataccgcggcggtagaaacgcttggtcctgttctggaaagccacgagcgttttccggagcgcgccaatatcggttttatgcaagtggttaagcgcgagcatattcgtttacgcgtttatgagcgtggggcaggagaaacccaggcctgcggcagcggcgcgtgtgcggcggttgcagtagggattcagcaaggtttgctggccgaagaagtacgcgtggaactccccggcggtcgtcttgatatcgcctggaaaggtccgggtcacccgttatatatgactggcccggcggtacatgtctacgacggatttattcatctatgaagcaaccaggggaagaactgcaggaaacactcacggagcttgatgaccgggcggttgtcgattatctgattaaaaatcctgagttttttatccgtaatgcgcgcgcagtagaagcgatacgtgtgccgcatccggtacgcggcaccgtttcgttggtcgagtggcacatggcccgcgcacgtaatcatattcatgttctggaagagaacatggcgctgttgatggaacaggctatcgccaacgaaggcctgttttatcgcctactctacctgcagcgcagtctcaccgccgccagcagtctcgacgatatgctgatgcgctttcaccgctgggcgcgcgatctcggcctggcaggtgcgagtctgcgcctgtttccggatcgctggcgcttaggtgcgccgtcgaaccacactcatctggcattaagccgtcagtctttcgaaccgctgcgtattcagcgtttggggcaggaacagcactatcttgggccgcttaacggaccagagctgctggtggtgctaccggaagcgaaagcggtgggatcggtggcgatgtcgatgctgggaagcgatgctgatttgggtgtcgtgctgtttaccagtcgcgatgccagtcactatcaacaagggcaaggaacgcagttacttcatgaaattgcgctgatgttgccggagcttctggagcgttggattgaacgcgtatgaccgatttacacaccgatgtagaacgctacctacgttatctgagcgtggagcgccagcttagcccgataaccctgcttaactaccagcgtcagcttgaggcgatcatcaattttgccagcgaaaacggcctgcaaagctggcagcaatgtgatgtgacgatggtgcgcaattttgctgtacgcagtcgccgtaaagggctgggagcagcaagtctggcgttacggctttctgcgctacgtagcttttttgactggctggtcagccagaacgaactcaaagctaacccggcgaaaggtgtttcggcaccgaaagcgccgcgtcatctgccgaaaaacatcgacgtcgacgatatgaatcggctgctggatattgatatcaatgatcccctcgctgtacgcgaccgtgcaatgctggaagtgatgtacggcgcgggtctgcgtctttctgagctggtggggctggatattaaacacctcgacctggagtctggtgaagtgtgggttatggggaaaggcagcaaagagcgccgcctgccgattggtcgcaacgctgtggcgtggattgagcactggcttgatttgcgcgacctgtttggtagcgaagacgacgcgctttttctgtcgaaactgggcaagcgtatctccgcgcgtaatgtgcagaaacgctttgccgaatggggcataaaacaagggctgaataatcacgttcatccgcataaattacgtcactcgttcgccacgcatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacacgcagcaatgatcaactttgccaaatggcgcagccgaatcgacgtcccgcagcaaactcacgacaccttaaaacagctggcgaagaaatggccgctggtggcgatcaccaacggtaacgcccagccggagctgtttggtttgggggattattttgagtttgtgctgcgcgctggcccgcacgggcgctcaaaaccgttcagcgatatgtactttttggctgcggaaaaactcaacgtgccgatcggcgagatcttacatgttggggacgatctcaccactgacgtgggtggggcaattcgcagcggaatgcaggcttgttggatcagaccggaaaatggcgatctgatgcaaacctgggacagccgtttactgccgcatctggaaatttcccggttggcatctctgacctcgctgatataatcagcaaatctgtatatatacccagctttttggcggagggcgttgcgcttctccgcccaacctatttttacgcggcggtgccaatggacgtttcttacctgctcgacagccttaatgacaaacagcgcgaagcggtggccgcgccacgcagcaaccttctggtgctggcgggcgcgggcagtggtaagacgcgcgtactggtgcatcgtatcgcctggttgatgagcgtggaaaactgctcgccatactcgattatggcggtgacgtttaccaacaaagcggcggcggagatgcgtcatcgtatcgggcaactgatgggcacgagccagggcggtatgtgggtcggcaccttccacgggctggcgcaccgtttgctgcgtgcgcaccatatggacgccaatctgccgcaggatttccagatcctcgacagtgaagaccagctacgcctgcttaagcgtctgatcaaagccatgaacctcgacgagaagcagtggccgccgcggcaggcaatgtggtacatcaacagccagaaagatgaaggcctgcgtccgcatcatattcaaagctacggtaatccggtggagcagacctggcagaaggtgtatcaggcgtatcaggaagcgtgtgaccgcgcgggcctggtggacttcgccgagctgctgctgcgcgctcacgagttgtggcttaacaagccgcatatcctgcaacactaccgcgaacgttttaccaatatcctggtggacgaattccaggataccaacaacattcagtacgcgtggatccgcctgctggcgggcgacaccggcaaagtgatgatcgtcggtgatgacgaccagtcaatctacggctggcgcggggcgcaggtggagaatattcagcgtttccttaatgatttccccggtgccgaaactattcgtctggagcaaaactaccgctctaccagcaatattctgagcgccgctaacgccctgattgaaaacaataacgggcgtctgggtaaaaaactgtggaccgatggcgcggacggtgagcctatttccctctattgcgcttttaacgaactcgatgaagcgcgttttgtggttaaccgcatcaaaacctggcaggacaacggcggagcgcttgccgagtgcgccattctctaccgcagcaacgcccagtcgcgggtgctcgaagaggcgttattgcaggccagtatgccgtaccgtatttacggcgggatgcgcttcttcgaacgccaggaaatcaaagatgcgctctcgtatctgcgcctgattgccaaccgcaacgacgacgcggcctttgagcgtgtggtgaatacgccaacgcggggtattggtgaccggacgctggacgtggtacgtcagacatcgcgcgatcgccagttaacactctggcaggcatgtcgtgagctgttgcaggaaaaagccctcgccgggcgagctgccagcgccttgcagcgatttatggaattaatcgacgccttagcgcaggaaactgccgatatgccgctgcatgtacagactgaccgggtaattaaagactccggcctgcgtaccatgtatgagcaggagaagggcgaaaaaggtcagacgcgtatcgaaaacttagaggaactggtgacggcaacgcgccagttcagctacaacgaagaagacgaagatttaatgccgctgcaggcgttcctctcccatgcggcactggaagcaggtgaagggcaggcggatacctggcaggatgcggtgcagttgatgacgctacactcggcgaaaggcctggagttcccgcaggtgtttatcgttggtatggaagagggcatgttcccaagccagatgtcgctggatgaaggcgggcgtctggaagaagaacgccgtctggcctacgttggcgtaacccgcgcgatgcagaaactgacgctgacctacgcggaaacccgccgtctgtatggtaaagaggtttaccatcgcccgtcgcgctttatcggcgagctgccggaagagtgtgtggaagaggtgcgcctgcgcgccacggtaagccgcccggtcagccatcagcggatgggtacgccgatggtcgagaacgacagcggctacaagctcggccagcgcgtacgccacgctaagtttggtgaaggcaccattgtcaatatggaaggcagcggtgagcatagccgtttgcaggtggcatttcagggccagggtattaaatggctggtggcggcatacgcccggctggagtcggtgtaacgttgccggatgcggtgctgcgcaccttatttggcctaaaaaatcattcagattcaataaattgcaacgtcatgtaggccggatagggcgtttacgccgcatccggcatctgcgccatcttcagtatctgacacaaaactatcgttttaacctttccgctcgacggaaatcatggtgacaaaaggatagcgttgccacgggattgccccgcctttcatatacatatgtgaaatcgtgccatcaagataaagcagctgctcaacgttcagtttcgctttggcataacaggcaaaatcataaaaatttgttgcctgctggctcaacaaaaacacggcgttcccatgtttattaatcccaacaccgttacgaattttgcttgaggcgacgttgggatgaatacgcggattaattacaccgttttccatcaacattggccctgactgcaccgcaaactgaatctctttactggttttgaaggcatccagacgaacgatgccgactttatctcccgcgacataaaacacgccgccaggacggataaagaaattcccttcacctgaagcgagatttaacgccaccttctgctgaccgttttcgatgtacaaaccgagcggcgcatagctttcatcatagatgccgccgttcatcgccatctgcacctgaccctgactattaatatccgccagcagagcatgtaacgttccccacgcttcgccattggctttttgccagtacattttcacccgctctgtttgaggattaacggtatacgcctgtacggtcagcgtcggatctgagagtgcgcaatcatcagcggcaacagcaaacaagggaagtaaggtgagggcgagaaaaatccgtttgagattcaaggtgatcattcctttaccaatgagtagctgatgcgccattataggtcctggatgtgggatttttttatcctgttagcgaccttgacgagtaccaaaaagcgcgaagttcaactattgttctgtggtgttctgttgcgtgttgacggcaaaattttgctggcgtaacatgcgcgcacgatcactctaagaggacattcgccttggacacacccagtagatactggctcactatcctgtcatccaggatcaactcctaaggctatccctttttgctgatagccttagcggttgtcagcgacctcaatttttcccgtcgcgctgagtcaggctgtttaatggtctgaaacccaatttgtttctgtgtgcccaccgaactgtccgatattttaagcattgggagtcccggtcatgctgagcgcatttcaactggaaaataaccgactgacccggctggaagtcgaagagtcacaaccccttgtaaatgcagtatggattgatcttgtcgaaccggacgacgacgagcgactgcgcgtacaatctgaacttggccagagcctggcaacccgcccggaactggaagacatcgaagcatcggcacgtttctttgaagacgacgacggcctgcatattcactccttcttcttctttgaagatgcggaagatcacgccggtaactccactgtggcatttaccatccgtgatggtcgtctgtttactctgcgtgagcgtgaactgcccgcttttcgtctgtatcgtatgcgtgcccgtagccagtcgatggtagacggtaacgcctacgagttgctgctggatctgttcgaaaccaaaatcgaacagttggcagatgaaattgaaaatatctatagcgacctggagcagttgagccgggtgattatggaagggcatcagggcgatgagtacgacgaggcgctctccactctggcggaactggaagatatcggctggaaagttcgcctgtgtctgatggatacccagcgcgcgctcaacttcctggtgcgtaaagcgcgtttaccgggtgggcaactggagcaggcgcgtgaaatcctgcgagatatcgaatccctgctgccgcataacgaatccctgttccagaaggtgaacttcctgatgcaggcggcaatgggttttatcaacatcgagcagaaccgcatcatcaaaatcttctcggtggtatccgtggtattcctgccgccgacgctcgttgcttccagctatggcatgaactttgagtttatgccagaactgaagtggagcttcggctaccctggcgcgattatctttatgatcctcgcgggcctggcaccgtatctgtactttaagcggaagaactggttgtaaaaaacgagagcggtggcttagtctggctaagccacctgttattcaaaggctccaggtatttaacccttttacctctttctcatagaaccatttgttcgtgttaacagcaacataggctgctacggcaattcccagaatgttaacgccaattagtgcaccaacaaatagagatagaataccaagtaatagaactataattgcttttttccataaccccaggacaaataaatatatccaggaacagaagaaagcaatgaaattcatttgaatagttaagcgttgtcttacttttaatgctttaaatgctgctttatattctggtgttgccccccagaatccaggaaaaccatgttgatcataaaaattaaatcggtatttccatttttcacttaatgaaccatcgttcatatattccttactcataaatactccataactattgttttgatgaatcagtaggtgcaagcattagcatactgaaagtggaaaaataacaaatcaaaaaaatcatcgaaccattgcctgaacaggcaaaatcttcggctatcattgtgatgatagagatgatatatactgctaatgtaccaaaaacataagtttttatatagatgaaaccactatcacggagtcgctggcaattcatgttgatgacgagataatggagtacgatggtagagactataacaagaaagcctgcttctccatcgttaaaaaagataataagaaaggcaaaaatgaaatttattaaaataaatgaaaatatataacgacgtctggaaatcttaccgttagatgttgggataaatatacgtaacataaattttacatccttgtatgagtctccggtcagcatggcaatatgcccactctcatgcaagagtcggcatattttttcagaatatatttattttttatttggacgttctacgctgcgtataaatcgcatccatcacaaaaattgccagcgccacccaaataaaggcgaaagtcaccatcttatcggcacccggtttttcaccataaaacgtcacagccagcaggaacatcagcgtcgggccaatgtactggaaaaagcctaacgttgagagacgcaagcgcgtggcagcggcggtaaaacacaacagcggtacggtagtgacaataccggcggcgatcagcagtaaattcagcgacatcgggttttgccccatatggctggttgagctgtcggcaatagcaaacaggtaaattgccgccacgggcagcagccacatggtttcgattaacatgccggtttgcgcttcaacggcaatcttcttgcgtaccagaccgtagaaggcaaaactaaatgccagtcccagcgcgataataggtagcgaaccaaaagtccacagctggactaacacgccacatatcgccagaatcaccgccagccattgcatccggcggaatcgctcgccgaggaaaatcatccccagcacaatgttcaccagcgggttaataaagtaaccaaggctcgcttccagcatatggtgattgttcaccgcccagataaacagtagccagttgccaccaatcagcacggcagagactgccagcataaaaattttctgtggcgtctgaatcagcgtttttaaataggaccactggcggcaaatgctcatcagcaccaccataaagaaaaacgaccagatcacgcgatgcgtcaggatttcatcggcgggcacgtagtaaatcaacttgaagtacgctggcgctataccccaaataaaataagcggcaagagcgagtaatacgccctgccgcgtttgttttgcatccatcgggaatactcatttttaattggtaacagcagtttacctgcttttatgtcttcaacctaccatataggtggcggtggcactggcaatataaagctgttcttcattgtgtaattcaacgcgggcgacggcgactttattgcctgcacgcaacaggctactagtagcagtaaaacgctcgcccctgcctgggcgcagataatcaacgcgaagatcaatggtccccatccgcgatagccgctggcgtagttcatcttcactgatggtttcgtggcgggttaaggtacttcccacgcacaccagaccggcggcgacatccagcgccgacgcaatgaccccgccgtgcaaaatgctttgcgcccagttgcccaccatcattggctgatttttaaaggccagctgtgcgaactctttttcgtaacgctccagttccatccccaatgcgcggttaaatggcatgtgataaacaaacatctcacccactaatttcagggcttgttcagcggtcagtacggcagacatatcatccttacacttcattggttaatgaaatgttgattttatgcttctttgttgttggtttctactttaggaagggataactaacggctatggagttaagtatgtaaaatagcccgcagaaaaatattcaccttatcaataattcgttacggagaacacgaccgatgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcacgctctatccttatgacaccaactacctcatttacacccaaaccagcgatctgaataaagaagcgattgccagttacgactgggcggaaaatgcgcgtaaggatgaagtaaagtttcagttgagcctggcatttccgctgtggcgtgggattttaggcccgaactcggtgttgggtgcgtcttatacgcaaaaatcctggtggcaactgtccaatagcgaagagtcttcaccgtttcgtgaaaccaactacgaaccgcaattgttcctcggttttgccaccgattaccgttttgcaggttggacgctgcgcgatgtggagatggggtataaccacgactctaacgggcgttccgacccgacctcccgcagctggaaccgcctttatactcgcctgatggcagaaaacggtaactggctggtagaagtgaagccgtggtatgtggtgggtaatactgacgataacccggatatcaccaaatatatgggttactaccagcttaaaatcggctatcacctcggtgatgcggtgctcagtgcgaaaggacagtacaactggaacaccggctacggcggcgcggagttaggcttaagttacccgatcaccaaacatgtgcgcctttatactcaggtttacagcggctatggcgaatcgctcatcgactataacttcaaccagacccgtgtcggtgtgggggttatgctaaacgatttgttttgatgaacggttgagtggttggcaaatctggaatccagcatccaggattaccctctcagagactaaaagcattgcagtttctcgcgcaggcgctgaaaatagcgcctgtttttatttcaggcaatcggggtgaatgtggcgcaggcggaagtgttgaatctggagtccggagctaaacaggttttacaagaaacctttggctaccaacagtttcgccccggccaggaagaaattatcgacactgtgctttccggccgcgattgcctcgtcgtcatgcccactggtggcggaaaatccctttgctatcaaatccctgccttattgctaaacggccttaccgtggttgtttcaccgctgatttcgttgatgaaagatcaggtggatcaactgcaagccaacggcgtggcggcggcgtgccttaactcgacgcaaacccgcgaacagcaacttgaagtgatgacaggctgccgcaccgggcaaattcgtctgctttatatcgccccggaacgcctgatgctggataactttcttgagcatctggcgcactggaatccggtgttattagccgttgatgaagcgcactgtatctcccaatggggccacgatttccgcccggaatatgccgcgctcggtcagttgcgccagcggttcccgacgctgccgtttatggcgctgaccgccacagccgacgacaccacgcgccaggatatcgtgcgcctgctggggctgaacgatccgctgattcaaatcagcagttttgaccgtccgaatattcgctacatgctgatggagaagttcaaaccgctcgatcagttgatgcgctacgtgcaggaacagcgcggtaagtcaggcattatctactgcaacagccgcgcgaaagtagaagacaccgctgcgcgcctgcaaagcaagggaattagcgcggcggcctatcatgccgggctggaaaataatgttcgcgccgatgtgcaggaaaaattccagcgcgatgacctgcaaattgtggtggcgacggtggcgttcggcatgggcatcaataaaccaaacgttcgcttcgtggtccactttgatattccgcgcaatatcgaatcctattatcaggaaaccggacgcgccgggcgtgatggcctgcccgcggaagcgatgctgttttacgatccggctgatatggcgtggctgcgccgttgtctggaagagaagccgcaggggcagttgcaggatatcgagcgccacaaactcaatgcgatgggcgcgtttgccgaagcgcaaacttgccgtcgtctggtattgctgaactattttggcgaagggcgtcaggagccgtgcgggaactgcgatatctgcctcgatccgccgaaacagtacgacggttcaaccgatgctcagattgccctttccaccattggtcgtgtgaatcagcggtttgggatgggttatgtggtggaagtgattcgtggtgctaataaccagcgtatccgcgactatggtcatgacaaactgaaagtctatggcatgggccgtgataaaagccatgaacattgggtgagcgtgatccgccagctgattcacctcggcctggtgacgcaaaatattgcccagcattctgccctacaactgacagaggccgcgcgcccggtgctgcgcggcgaatcctctttgcaacttgccgtgccgcgtatcgtggcgctcaaaccgaaagcgatgcagaaatcgttcggcggcaactatgatcgcaaactgttcgccaaattacgcaaactgcgtaaatcgatagccgatgaaagtaatgtcccgccgtacgtggtgtttaacgacgcaaccttgattgagatggctgaacagatgccgatcaccgccagcgaaatgctcagcgttaacggcgttgggatgcgcaagctggaacgctttggcaaaccgtttatggcgctgattcgtgcgcatgttgatggcgatgacgaagagtagtcagcagcataaaaaagtgccagtatgaagactccgtaaacgtttcccccgcgagtcaaatgtatgttgatgttatttctcaccgtcgccatggtgcacattgtggcgcttatgagccccggtcccgatttcttttttgtctctcagaccgctgtcagtcgttcccgtaaagaagcgatgatgggcgtgctgggcattacctgcggcgtaatggtttgggctgggattgcgctgcttggcctgcatttgattatcgaaaaaatggcctggctgcatacgctgattatggtgggcggtggcctgtatctctgctggatgggttaccagatgctacgtggtgcactgaaaaaagaggcggtttctgcacctgcgccacaggtcgagctggcgaaaagtgggcgcagtttcctgaaaggtttactgaccaatctcgctaatccgaaagcgattatctactttggctcggtgttctcattgtttgtcggtgataacgttggcactaccgcgcgctggggcatttttgcgctgatcattgtcgaaacgctggcgtggtttaccgtcgttgccagcctgtttgccctgccgcaaatgcgccgtggttatcaacgtctggcgaagtggattgatggttttgccggggcgttatttgccggatttggcattcatttgattatttcgcggtgatgccagacgcgtcttcagagtaagtcggataaggcgtttacgccgcatccgacattatttttcacgcatgcctcgccgatgctaacagcgctcccaccagcataaacaacgagccgaaaatcttattcagcgccttcatctgctttggtcctttaatccatagagcaatccgttgagcaagggtggcgtaaccgatcatcacaataatatcgaccacaatagtggtgacgccgagcacgatatactgcatcagttgcggctgttgcggcatgatgaattgcggaaatagcgccgccagaaacacaatacttttgggattggtgagattcacaaaaactgcgcgctggaacaaatgtcgacgcgattgagtagaggccagcgatttaaggtcaattgcaccagcggcgcgccactgctggattcccagccaaatcaagtaagccgcgcctgcccacttcaacacttcaaacgcaatcactgagcgggaaaatagcgtccccaaccccacgccaaccagcacaatatgaatcgccagtccggtctgaagcccagcaatagacgccaccgcgccgcgataaccgtggttgagcgaggtggtcatagtgttgattgcaccagagcctggcgacaggcttaaaatgatcgatgtcagcaggtaggcaaaccaccattctaaggtcatgatgaactcccggtgtgtctatttttgtgccacaatacgctactgtcgcagcgttgtgtcaggcacgctaaaaaaaacgattttacgtggtttaagaggcagattacccgatgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatgcgctcagtcgcgctccacgccatcgttgattttttcaacaggcataactcacccagcggaaaccgctctacagaggtttaaatttcttatgtaccaggttgttgcgtctgatttagatggcacgttactttctcccgaccatacgttatccccttacgccaaagaaactctgaagctgctcaccgcgcgcggcatcaactttgtgtttgcgaccggtcgtcaccacgttgatgtggggcaaattcgcgataatctggagattaagtcttacatgattacctccaatggtgcgcgcgttcacgatctggatggtaatctgatttttgctcataacctggatcgcgacattgccagcgatctgtttggcgtagtcaacgacaatccggacatcattactaacgtttatcgcgacgacgaatggtttatgaatcgccatcgcccggaagagatgcgcttttttaaagaagcggtgttccaatatgcgctgtatgagcctggattactggagccggaaggcgtcagcaaagtgttcttcacctgcgattcccatgaacaactgctgccgctggagcaggcgattaacgctcgttggggcgatcgcgtcaacgtcagtttctctaccttaacctgtctggaagtgatggcgggcggcgtttcaaaaggccatgcgctggaagcggtggcgaagaaactgggctacagcctgaaggattgtattgcgtttggtgacgggatgaacgacgccgaaatgctgtcgatggcggggaaaggctgcattatgggcagtgcgcaccagcgtctgaaagaccttcatcccgagctggaagtgattggtactaatgccgacgacgcggtgccgcattatctgcgtaaactctatttatcgtaatcgttctttatttggtcagttgtcaacctgatacttcgctacaatggatacccgttaatcaaagagttttccattgtggcgctacttatcatcaccacgattctgtgggccttctcctttagcttttatggcgagtaccttgcggggcacgtcgatagctattttgcggtgctggtgcgcgttggcctggcggcactcgtttttctgccgtttctgcgtacccgtggcaatagcctgaaaacggtcggcctgtatatgctggtgggcgcgatgcagcttggcgtgatgtatatgctgagtttccgcgcttatctctacctgacggtttccgagctgctgctgttcaccgtgctgacgccgctctacatcacgctgatttatgacatcatgagtaagcgccgtctgcgctggggctatgcctttagcgccttgctggcggtgattggtgccgggattattcgctatgatcaggtcaccgaccatttctggactggcttgctgctggtgcaactctccaatatcacttttgccattggcatggtgggttacaaacgcctgatggaaactcgcccgatgccacagcataacgcctttgcgtggttctatcttggcgcgtttctggtggcagtgattgcatggttcttgctgggaaatgcgcagaaaatgccgcaaaccacgctgcaatggggcattctggtgtttcttggcgtggtggcttccgggattggctactttatgtggaactacggcgcgacgcaggtggacgccggaacgctgggcattatgaataatatgcacgttccggcagggctgctggtaaacctggctatctggcaccaacagccgcactggccaacgtttattacaggcgcgctggtgatcctggcctcactgtgggtgcatcgtaagtgggtcgctccgcgctcttcacaaacggcagatgatcgcaggcgtgattgcgcgctgagcgaataaacgcttccgtaactggctgacgctgctcgccatcgcgcacggcggcgtacagtcggctccacaagccttcgcccagggttttggtcaccaccagaccctggcgctcaaaactctctactacccaatgcggtagcgcggcaatacccatccgcgcggcaaccatctgaatcaacaataaggtgttatcgacgcttttcagtgacgggctgacgcctgccggctgaagaaaatgccgccagacatccagtcgactacgctgcaccggataaattaatagcgtctcgctggcgagatcttccggtgtaattcgcgttttcgccgccagtggatggtcaggtgctaacaccagacgcacttcatagtcgaacatcggcgaataatgcaggccactgcgcggcagaatatcggacgtcattaccagatccagctctccctgttgcaaggcgggctgcgggtcaaatgtcacgcccgatttaaaatccatctctacctgcggccagttcttatggaaattttctaacgcgggtgtcagccactgaatacagctatggcactcaatggcaatgcgcagacgcgtctgctgcggttcattgcaggcttgcagggcctggctaatttgcggcagtacctggtttgccagttgcaacaggatttctccctgcggtgtaaagcgtagcggctggctcttacgcacaaatagccggaagccaaggcgttgttccagatcgctaaactggtgagacagggcggattgcgtctgatgcaacgtcgccgcagcggctgcgagcgagccgcagttccgcaacgcttgtagcgttttcaggtgttttacttcgatcatgaaagtccttcacttcggcatgaataatttgcgcttgaggaatatacagtaaccgccaattatggatgtgtaaacatctggacggctaaaatccttcgtcttttaaatttatggtgcgttggctgcgtttctccaccccggtcacttacttcagtaagctcccggggatgaataaacttgccgccttccctaaattcaaaatccataggatttacatataattagaggaagaaaaaatgacaatattgaatcacaccctcggtttccctcgcgttggcctgcgtcgcgagctgaaaaaagcgcaagaaagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaacgttccggcgcgtcatcagaacaaagatggttcggtagatatcgacaccctgttccgtattggtcgtggacgtgcgccgactggcgaacctgcggcggcagcggaaatgaccaaatggtttaacaccaactatcactacatggtgccggagttcgttaaaggccaacagttcaaactgacctggacgcagctgctggacgaagtggacgaggcgctggcgctgggccacaaggtgaaacctgtgctgctggggccggttacctggctgtggctggggaaagtgaaaggtgaacaatttgaccgcctgagcctgctgaacgacattctgccggtttatcagcaagtgctggcagaactggcgaaacgcggcatcgagtgggtacagattgatgaacccgcgctggtactggaactaccacaggcgtggctggacgcatacaaacccgcttacgacgcgctccagggacaggtgaaactgctgctgaccacctattttgaaggcgtaacgccaaatctcgacacgattactgcgctgcctgttcagggtctgcatgttgacctcgtacatggtaaagatgacgttgctgaactgcacaagcgcctgccttctgactggttgctgtctgcgggtctgatcaatggtcgtaacgtctggcgcgccgatcttaccgagaaatatgcgcaaattaaggacattgtcggcaaacgtgatttgtgggtggcatcttcctgctcgttgctgcacagccccatcgacctgagcgtggaaacgcgtcttgatgcagaagtgaaaagctggtttgccttcgccctacaaaaatgccatgaactggcactgctgcgcgatgcgctgaacagtggtgacacggcagctctggcagagtggagcgccccgattcaggcacgtcgtcactctacccgcgtacataatccggcggtagaaaagcgtctggcggcgatcaccgcccaggacagccagcgtgcgaatgtctatgaagtgcgtgctgaagcccagcgtgcgcgttttaaactgccagcgtggccgaccaccacgattggttccttcccgcaaaccacggaaattcgtaccctgcgtctggatttcaaaaagggcaatctcgacgccaacaactaccgcacgggcattgcggaacatatcaagcaggccattgttgagcaggaacgtttgggactggatgtgctggtacatggcgaggccgagcgtaatgacatggtggaatactttggcgagcacctcgacggatttgtctttacgcaaaacggttgggtacagagctacggttcccgctgcgtgaagccaccgattgtcattggtgacattagccgcccggcaccgattaccgtggagtgggcgaagtatgcgcaatcgctgaccgacaaaccggtgaaagggatgctgacggggccggtgaccatactctgctggtcgttcccgcgtgaagatgtcagccgtgaaaccatcgccaaacagattgcgctggcgctgcgtgatgaagtggccgatctggaagccgctggaattggcatcatccagattgacgaaccggcgctgcgcgaaggtttaccgctgcgtcgtagcgactgggatgcgtatctccagtggggcgtagaggccttccgtatcaacgccgccgtggcgaaagatgacacacaaatccacactcacatgtgttattgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgcctgtgggtcaacccggactgtggcctgaaaacgcgcggctggccagaaacccgcgcggcactggcgaacatggtgcaggcggcgcagaacttgcgtcgggggtaaaatccaaaccgggtggtaataccacccggtcttttctcattacagcgacttcttcccaccatactgcttaaaccattccagcatacgctgccagccatcttctgcagatgcggcatgatagctcgggcgataatcagcgttgaatgcatgcccggcgtccgggtacacgataatctctgctttcgcattagcagcccgcagcgcctggcgcatggtttcaacgctctcctgcggaatgctgttatcctgaccaccatataagccgagaatcggcgcgttaagatcggttgcgatatcaacaggttgtttcggtgaattcagcgacttgtcgcccgtcagtttgccgtaccacgccactgcggcttttagctgtggattatgcgcggcatacagccaggtgatacgtccaccccagcagaatccggtgatcattaaacgatgaacatcgccgccgttgcgggaagcccaactggcgacatgatcgagatcggccagcacctgcgagtcaggcacttttgctaccagaccgctaagcaacgtggggatatcggcaaaatcattcggatcgccttcgcggaagtaaagttcaggtgcgatagccagatacccctccagcgccagacggcgacaaatgtcgcggatatgttcatgcacgccaaaaatttcctgcactacaatgaccactggcagtgggccatcgctttgctttggtctggcatggtaagcaggcatgttatccccttgtgaagggatagaggtgaagcccgccacaatcgcgtcgtccggggtctgaacgatggtcgaagcgagaggcgatgcagcaggtgcaaatccagattgttgtgttgttgccatggtattctccgtacccttataaaaatgttgcgcaatgttaactatagtcagcatgcaacaaatcacattgcctgaatcggctcatcttttatgcagtcctgcagaatgaagggtgatttatgtgatttgcatcacttttggtgggtaaatttatgcaacgcatttgcgtcatggtgatgagtatcacgaaaaaatgttaaacccttcggtaaagtgtctttttgcttcttctgactaaaccgattcacagaggagttgtatatgtccaagtctgatgtttttcatctcggcctcactaaaaacgatttacaaggggctacgcttgccatcgtccctggcgacccggatcgtgtggaaaagatcgccgcgctgatggataagccggttaagctggcatctcaccgcgaattcactacctggcgtgcagagctggatggtaaacctgttatcgtctgctctaccggtatcggcggcccgtctacctctattgctgttgaagagctggcacagctgggcattcgcaccttcctgcgtatcggtacaacgggcgctattcagccgcatattaatgtgggtgatgtcctggttaccacggcgtctgtccgtctggatggcgcgagcctgcacttcgcaccgctggaattcccggctgtcgctgatttcgaatgtacgactgcgctggttgaagctgcgaaatccattggcgcgacaactcacgttggcgtgacagcttcttctgataccttctacccaggtcaggaacgttacgatacttactctggtcgcgtagttcgtcactttaaaggttctatggaagagtggcaggcgatgggcgtaatgaactatgaaatggaatctgcaaccctgctgaccatgtgtgcaagtcagggcctgcgtgccggtatggtagcgggtgttatcgttaaccgcacccagcaagagatcccgaatgctgagacgatgaaacaaaccgaaagccatgcggtgaaaatcgtggtggaagcggcgcgtcgtctgctgtaattctcttctcctgtctgaaggccgacgcgttcggccttttgtatttttgcgtagcgcctcgcaggaaatgcctttccaactggacgtttgtacagcacaattctattttgtgcgggtaagttgttgcgtcaggaggcgttgtggatttctcaatcatggtttacgcagttattgcgttggtgggtgtggcaattggctggctgtttgccagttatcaacatgcgcagcaaaaagccgagcaattagctgaacgtgaagagatggtcgcggagttaagcgcggcaaaacaacaaattacccaaagcgagcactggcgtgcagagtgcgagttactcaataacgaagtgcgcagcctgcaaagtattaacacctctctggaggccgatctgcgtgaagtaaccacgcggatggaagccgcacagcaacatgctgacgataaaattcgccagatgattaacagcgagcagcgcctcagtgagcagtttgaaaacctcgccaaccgtatttttgagcacagcaatcgccgggttgatgagcaaaaccgtcagagtctgaacagcctgttgtcgccgctacgtgaacaactggacggtttccgccgtcaggttcaggacagcttcggtaaagaagcacaagaacgccataccctgacccacgaaattcgcaatctccagcaactcaacgcgcaaatggcccaggaagcgatcaacctgacgcgcgcgctgaaaggcgacaataaaacccagggcaactggggcgaggtagtattgacgcgggtgctggaggcttccggtctgcgtgaagggtatgaatatgaaacccaggtcagcatcgaaaatgacgcccgctcgcggatgcagccggatgtcatcgtgcgcctgccgcagggaaaagatgtggtgatcgacgccaaaatgacgctggtcgcctatgaacgctattttaacgccgaagacgactacacccgcgaaagcgcgctacaggaacatatcgcgtcggtgcgtaaccatatccgtttgctgggacgcaaagattatcaacagctgccggggctgcgaactctggattacgtgctgatgtttattcccgttgaacccgcttttttactggcgcttgaccgccagccggagctgatcaccgaagcgttgaaaaacaacatcatgctggttagcccgactacgctgctggtggcgctgcgcactatcgccaacctgtggcgttatgagcatcaaagccgcaacgcccagcaaatcgccgatcgtgccagcaagctgtacgacaagatgcgtttgttcatcgatgacatgtccgcgattggtcaaagtctcgacaaagcgcaggataattatcggcaggcaatgaaaaaactctcttcagggcgcggaaatgtgctggcgcaggcagaagcgtttcgcggtttaggagtagaaattaaacgcgagattaatccggatttggctgaacaggcggtgagccaggatgaagagtatcgacttcggtcggttccggagcagccgaatgatgaagcttatcaacgcgatgatgaatataatcagcagtcgcgctagcccattgggagtagttaagccgggtagaaatctagggcatcgacgcccaatctgttacacttctggaacaattttttgatgagcaggcattgagatggtggataagtcacaagaaacgacgcactttggttttcagaccgtcgcgaaggaacaaaaagcggatatggtcgcccacgttttccattccgtggcatcaaaatacgatgtcatgaatgatttgatgtcatttggtattcatcgtttgtggaagcgattcacgattgattgcagcggcgtacgccgtgggcagaccgtgctggatctggctggtggcaccggcgacctgacagcgaaattctcccgcctggtcggagaaactggcaaagtggtccttgctgatatcaatgaatccatgctcaaaatgggccgcgagaagctgcgtaatatcggtgtgattggcaacgttgagtatgttcaggcgaacgctgaggcgctgccgttcccggataacacctttgattgcatcaccatttcgtttggtctgcgtaacgtcaccgacaaagataaagcactgcgttcaatgtatcgcgtgctgaaacccggcggccgcctgctggtgcttgagttctcgaagccaattatcgagccgctgagcaaagcctatgatgcatactccttccatgtgctgccgcgtattggctcactggtcgcgaacgacgccgacagctaccgttatctggcagaatccatccgtatgcatcccgatcaggataccctgaaagccatgatgcaggatgccggattcgaaagtgtcgactactacaatctgacggcaggggttgtggcgctgcatcgtggttataagttctgacaggagaccggaaatgccttttaaacctttagtgacggcaggaattgaaagtctgctcaacaccttcctgtatcgctcacccgcgctgaaaacggcccgctcgcgtctgctgggtaaagtattgcgcgtggaggtaaaaggcttttcgacgtcattgattctggtgttcagcgaacgccaggttgatgtactgggcgaatgggcaggcgatgctgactgcaccgttatcgcctacgccagtgtgttgccgaaacttcgcgatcgccagcagcttaccgcactgattcgcagtggtgagctggaagtgcagggcgatattcaggtggtgcaaaacttcgttgcgctggcagatctggcagagttcgaccctgcggaactgctggccccttataccggtgatatcgccgctgaaggaatcagcaaagccatgcgcggaggcgcaaagttcctgcatcacggcattaagcgccagcaacgttatgtggcggaagccattactgaagagtggcgtatggcacccggtccgcttgaagtggcctggtttgcggaagagacggctgccgtcgagcgtgctgttgatgccctgaccaaacggctggaaaaactggaggctaaatgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacttttaggtgagcgactacgactggccctgcaagaactggggccggtttggatcaagttcgggcaaatgttatcaacccgccgcgatctttttccaccgcatattgccgatcagctggcgttattgcaggacaaagttgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagtcatccgcccggatattttgccggttattaaagcggatctgaaacttatctaccgtctggctcgctgggtgccgcgtttgctgccggatggtcgccgtctgcgcccaaccgaagtggtgcgcgagtacgaaaagacattgattgatgaactgaatttgctgcgggaatctgccaacgccattcagcttcggcgcaattttgaagacagcccgatgctctacatcccggaagtttaccctgactattgtagtgaagggatgatggtgatggagcgcatttacggcattccggtgtctgatgttgcggcgctggagaaaaacggcactaacatgaaattgctggcggaacgcggcgtgcaggtgttcttcactcaggtctttcgcgacagctttttccatgccgatatgcaccctggcaacatcttcgtaagctatgaacacccggaaaacccgaaatatatcggcattgattgcgggattgttggctcgctaaacaaagaagataaacgctatctggcagaaaactttatcgccttctttaatcgcgactatcgcaaagtggcagagctacacgtcgattctggctgggtgccaccagataccaacgttgaagagttcgaatttgccattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcctgaattggtttacgacagtttgcgccagggcaagtatttacagcacagtgttgataagattgcccgcgagcttcagtcaaatcatgtacgtcagggacaatcgcgttattttctcggaattggcgctacgttagtattaagtggcacattcttgttggtcagccgacctgaatgggggctgatgcccggctggttaatggcaggtggtctgatcgcctggtttgtcggttggcgcaaaacacgctgattttttcatcgctcaaggcgggccgtgtaacgtataatgcggctttgtttaatcatcatctaccacagaggaacatgtatgggtggtatcagtatttggcagttattgattattgccgtcatcgttgtactgctttttggcaccaaaaagctcggctccatcggttccgatcttggtgcgtcgatcaaaggctttaaaaaagcaatgagcgatgatgaaccaaagcaggataaaaccagtcaggatgctgattttactgcgaaaactatcgccgataagcaggcggatacgaatcaggaacaggctaaaacagaagacgcgaagcgccacgataaagagcaggtgtaatccgtgtttgatatcggttttagcgaactgctattggtgttcatcatcggcctcgtcgttctggggccgcaacgactgcctgtggcggtaaaaacggtagcgggctggattcgcgcgttgcgttcactggcgacaacggtgcagaacgaactgacccaggagttaaaactccaggagtttcaggacagtctgaaaaaggttgaaaaggcgagcctcactaacctgacgcccgaactgaaagcgtcgatggatgaactacgccaggccgcggagtcgatgaagcgttcctacgttgcaaacgatcctgaaaaggcgagcgatgaagcgcacaccatccataacccggtggtgaaagataatgaagctgcgcatgagggcgtaacgcctgccgctgcacaaacgcaggccagttcgccggaacagaagccagaaaccacgccagagccggtggtaaaacctgctgcggacgctgaaccgaaaaccgctgcaccttccccttcgtcgagtgataaaccgtaaacatgtctgtagaagatactcaaccgcttatcacgcatctgattgagctgcgtaagcgtctgctgaactgcattatcgcggtgatcgtgatattcctgtgtctggtctatttcgccaatgacatctatcacctggtatccgcgccattgatcaagcagttgccgcaaggttcaacgatgatcgccaccgacgtggcctcgccgttctttacgccgatcaagctgacctttatggtgtcgctgattctgtcagcgccggtgattctctatcaggtgtgggcatttatcgccccagcgctgtataagcatgaacgtcgcctggtggtgccgctgctggtttccagctctctgctgttttatatcggcatggcattcgcctactttgtggtctttccgctggcatttggcttccttgccaataccgcgccggaaggggtgcaggtatccaccgacatcgccagctatttaagcttcgttatggcgctgtttatggcgtttggtgtctcctttgaagtgccggtagcaattgtgctgctgtgctggatggggattacctcgccagaagacttacgcaaaaaacgcccgtatgtgctggttggtgcattcgttgtcgggatgttgctgacgccgccggatgtcttctcgcaaacgctgttggcgatcccgatgtactgtctgtttgaaatcggtgtcttcttctcacgcttttacgttggtaaagggcgaaatcgggaagaggaaaacgacgctgaagcagaaagcgaaaaaactgaagaataaattcaaccgcccgtcagggcggttgtcatatggagtacaggatgtttgatatcggcgttaatttgaccagttcgcaatttgcgaaagaccgtgatgatgttgtagcgtgcgcttttgacgcgggagttaatgggctactcatcaccggcactaacctgcgtgaaagccagcaggcgcaaaagctggcgcgtcagtattcgtcctgttggtcaacggcgggcgtacatcctcacgacagcagccagtggcaagctgcgactgaagaagcgattattgagctggccgcgcagccagaagtggtggcgattggtgaatgtggtctcgactttaaccgcaacttttcgacgccggaagagcaggaacgcgcttttgttgcccagctacgcattgccgcagatttaaacatgccggtatttatgcactgtcgcgatgcccacgagcggtttatgacattgctggagccgtggctggataaactgcctggtgcggttcttcattgctttaccggcacacgcgaagagatgcaggcgtgcgtggcgcatggaatttatatcggcattaccggttgggtttgcgatgaacgacgcggactggagctgcgggaacttttgccgttgattccggcggaaaaattactgatcgaaactgatgcgccgtatctgctccctcgcgatctcacgccaaagccatcatcccggcgcaacgagccagcccatctgccccatattttgcaacgtattgcgcactggcgtggagaagatgccgcatggctggctgccaccacggatgctaatgtcaaaacactgtttgggattgcgttttagagtttgcggaactcggtattcttcacactgtgcttaatctctttattaataagattaagcaatagcatggagcgagcctcaccatcgggttcggtgaaaatggcctgaaagccttcgaacgcgccttcggtaataatcaccttatcacccggataaggggttgccggatcgacaatgtctttcggtttatataccgatagctgatgaataaccgccgatgggactatcgctggcgacgcgccaaagcgcacgaagtggctgacaccgcgggtcgcgttgatagtcgtggtatgaatcacttctgggtcaaattccacaaacaggtagttggggaacaatggctcactgactgcagtacgttttccacgcacgattttttccagggtgatcatcggtgccaggcaattcacagcctgtctttcgaggtgttcctgggcacgttgaagttgcccgcgcttgcagtacagtaaataccaggattgcataatgactcttatccgtttaatcggggcgcaaggatagcaaaagctttacgctaagttaattatattccccggtttgcgttataccgtcagagttcacgctaatttaacaaatttacagcatcgcaaagatgaacgccgtataatgggcgcagattaagaggctacaatggacgccatgaaatataacgatttacgcgacttcttgacgctgcttgaacagcagggtgagctaaaacgtatcacgctcccggtggatccgcatctggaaatcactgaaattgctgaccgcactttgcgtgccggtgggcctgcgctgttgttcgaaaaccctaaaggctactcaatgccggtgctgtgcaacctgttcggtacgccaaagcgcgtggcgatgggcatggggcaggaagatgtttcggcgctgcgtgaagttggtaaattattggcgtttctgaaagagccggagccgccaaaaggtttccgcgacctgtttgataaactgccgcagtttaagcaagtattgaacatgccgacaaagcggctgcgtggtgcgccctgccaacaaaaaatcgtctctggcgatgacgtcgatctcaatcgcattcccattatgacctgctggccggaagatgccgcgccgctgattacctgggggctgacagtgacgcgcggcccacataaagagcggcagaatctgggcatttatcgccagcagctgattggtaaaaacaaactgattatgcgctggctgtcgcatcgcggcggcgcgctggattatcaggagtggtgtgcggcgcatccgggcgaacgtttcccggtttctgtggcgctgggtgccgatcccgccacgattctcggtgcagtcactcccgttccggatacgctttcagagtatgcgtttgccggattgctacgtggcaccaagaccgaagtggtgaagtgtatctccaatgatcttgaagtgcccgccagtgcggagattgtgctggaagggtatatcgaacaaggcgaaactgcgccggaagggccgtatggcgaccacaccggttactataatgaagtcgatagtttcccggtatttaccgtgacgcatattacccagcgtgaagatgcgatttaccattccacctataccgggcgtccgccagatgagcccgcggtgctgggtgtcgcactgaacgaagtgtttgtgccgattctgcaaaaacagttcccggaaattgtcgatttttacctgccgccggaaggctgctcttatcgcctggcggtagtgacaatcaaaaaacagtacgccggacacgcgaagcgcgtcatgatgggcgtctggtcgttcttacgccagtttatgtacactaaatttgtgatcgtttgcgatgatgacgttaacgcacgcgactggaacgatgtgatttgggcgattaccacccgtatggacccggcgcgggatactgttctggtagaaaatacgcctattgattatctggattttgcctcgcctgtctccgggctgggttcaaaaatggggctggatgccacgaataaatggccgggggaaacccagcgtgaatggggacgtcccatcaaaaaagatccagatgttgtcgcgcatattgacgccatctgggatgaactggctatttttaacaacggtaaaagcgcctgatgcgcgtttgttttgccctatttatcgatccgacagagaaagcgcatgacaaccttaagctgtaaagtgacctcggtagaagctatcacggataccgtatatcgtgtccgcatcgtgccagacgcggccttttcttttcgtgctggtcagtatttgatggtagtgatggatgagcgcgacaaacgtccgttctcaatggcttcgacgccggatgaaaaagggtttatcgagctgcatattggcgcttctgaaatcaacctttacgcgaaagcagtcatggaccgcatcctcaaagatcatcaaatcgtggtcgacattccccacggagaagcgtggctgcgcgatgatgaagagcgtccgatgattttgattgcgggcggcaccgggttctcttatgcccgctcgattttgctgacagcgttggcgcgtaacccaaaccgtgatatcaccatttactggggcgggcgtgaagagcagcatctgtatgatctctgcgagcttgaggcgctttcgttgaagcatcctggtctgcaagtggtgccggtggttgaacaaccggaagcgggctggcgtgggcgtactggcaccgtgttaacggcggtattgcaggatcacggtacgctggcagagcatgatatctatattgccggacgttttgagatggcgaaaattgcccgcgatctgttttgcagtgagcgtaatgcgcgggaagatcgcctgtttggcgatgcgtttgcatttatctgagatataaaaaaacccgcccctgacaggcgggaagaacggcaactaaactgttattcagtggcatttagatctatgacgtatctggcaaaccatgcccgatgcgacgctgtcgcgtcttatcgtgcctacaaatagtccgaaccgtaggccggataaggcgtttacgccgcatccggcaattggtgcatgatgcctgatgcgacgctgtcgcgtcttatcgtgcctacaaatagtccgaaccgtaggccggataaggcgtttacgccgcatccggcaattggtgcatgatgcctgatgcgacgctggcgcgtcttatcaggcctacattggtgccggatcggtagaccggataaggcgttcacgccgcatccggcaagtggttaaacccgctcaaacaccgtcgcaataccctgacccagaccgatacacatcgtcgccagaccaaactgaacgtctttgcgttccatcagattcagcagcgtggtgctgatacgcgcaccggaacaacccagcggatgacccagcgcgatcgcgccaccgttgaggttgatcttctcgtcaatctgctcaattagtcccagatctttaatacatggcaggatctgcgcggcaaaggcttcgttcatttcaaacacgccgatatcgctggcagaaagccccgcttttttcagcgccagtttcgaggccggaaccgggccgtaacccataatcgatgggtcacaaccaacgaccgccatcgaacgcacacgagcgcgcggcttaagacctaattcatgggcgcggctttcactcatcaccagcatggcagctgcgccatcggaaagtgcagaagatgtgcccgccgttaccataccgtttactggatcaaacgccggacgcagcgtggcgagggcttccacggtggtttccgggcgaatcacttcgtcgtaattaaactgcttcaggacgccgtcggcatcgtgaccaccggtcgggatgatttcatttttaaatgcggccgactgcgtggcggcccaggcgcgggcgtgtgaccgcgcggcaaaggcatcctgcatttcacggctgataccgtgcatacgcgccagcatttctgccgttaagcccatcatgcccgccgctttggcgacattgcggctcaggccggggtgaaaatcgacgccgtgactcatcggcacatggcccatatgctccacgccgccaaccagacatgcctgcgcatcgccagtcatgatcattcgtgctgcgtcatgcagtgcctgcatggatgaaccacacaagcgattaacggtaaccgccgggacagagtgtggtacttctgccagcagcgccgcgttacgggcgatattaaaaccctgctccagcgtctgctgcacacaaccccagtaaatatcgtcgagggccgccgcttccagcgccgggttacgcgccagcaggctacgcattaaatgagcggagagatcttctgcacgcacgttacgaaaagcaccgcccttcgaacggcccatcggggtgcgaattgcatcgacaatgacaacctgttccattgtgactccttaagccgttttcaggtcgccaaccggacgggctggctcaaccggaggatagtacggttcgttatgacgcgctttattacgcagaccttccggcacttcatacagcgggccgaggtgctgatattgctgtgccatatcgaggtattttgcgctaccgagggtgtccagccagcggaacgcgccgccgtggaacggagggaagcccaggccgtagaccagcgccatatccgcttccgccggagtggcgataatgccttcctccagacagcgcaccacttcgttgaccatcgggatcatcatgcgggcgataatctcttcttcgctgaaatcgcgcttcggctggctcacttctgccagcaggtcttcaacggcggcgtcttcttctttcttcggcttacctttgctgtcttctttataacgccagaaaccgaggccgttcttctgaccaaagcggttggcatcaaacagcgcgtcgatggcatcgcggtaatctttctgcatccgctgcgggaagcctgctgccatgacagcctgagcgtgatgcgcggtatcaatgcccacaacgtccagcagatatgccgggcccatcggccagccaaactgtttttccatcactttgtcgatcttgcggaaatccgcgccgtcgcgcagcagctggctgaaaccggcgaaatacgggaacagcacgcggttaacaaagaagccggggcagtcgttaaccacaatcggcgtcttgcccatcttgctcgcccaggcgacaactttcgcgatggtttcgtcggagcttttctcgccgcgaataatttctaccaacggcattcggtggaccgggttaaagaagtgcatcccgcagaagttttccgggcgttccagcgcgttggccagttcgctgataggaatggttgaagtgttagacgccagcacggtatcctggcgtactttttgttcggtttctgccagtacggcttttttcactttcgggttttcaacaaccgcttctaccacaatatccacgcggtcaaatccggcgtagtcgagcgttgggtggattgtggagatcacgccagccagtttcagaccatcgatcttgccgcgctcaagctgcttgttcagcagtttcgcggcttcggtcatgccgagggttaacgacttgtcgttgatatctttcatgacaaccggcacgcctttccacgcagactggtaagcgatgccgccgcccataatgcctgcacccagcaccgcggcctgtttcggggtttcaacgtctttggtgagtttcttcgctttgccttttacatattgatcgttaaggaaaatgccgaccagtgcgcgggcttcgttggtatgcgccagcgggacaaaacttttgttttccaggtttaaggcttcttcacgaccaaaacgggccgcagcttcaatggtttttactgcggtgatgggggccggataatgtttccccgctgtttgtgcgaccatccctttagcgatggtgaagctcatggtggcttcaatcttgctcagttttagtggttccagcttcggctgacgttttgctttccagtcgaggtcgccgttaatggcctggcgtaaaaccgcctttgcgccttcaaccagtttttctgctttgactacgccatccaccagaccgattttcagcgcctgatccgcgccgacatctttaccggcggcaatgatttccagcgcactgtcagcgcccagcatacgtggcatacgtacagaaccgccaaagccaggcatgatgcccagtttggtttccggcagaccgatgcgcagatccggcgtcgccagacgataatcggtcgccagcacgcattcgcagccaccgcccagcgcatagccattgacggcagcaatggtcggcaccggcagatcttccaggcgattaaacacgctattggcaaagtgcagccactgacttaactgttcttcaggaacgaggaacagggacaaaaattcggtgatatcagcaccgacgataaaggctgctttgttcgaacgcagcagcagcccttttagatctgattgctgttccagcacgccgatggcctcgccgaggctggcgacggtcgcagtgtcgagtttattaactgaacctggggcatcaaataccagttcggcaatgccatcttccagccagtcaaggtacagggtgtcgcctttgtaaagcatgtcagtctcctgaatccgcaaggtgatctggtcgtaccagatgagtcgaagtgtgtattttgtgttaaaaatatgcaaacaaaagattaaagaaatgccgatctgatcacgctcggcagaaatcacgctctggatgaacgatgtgctaagatgcggagacttaaggtcaaaaaaacagaagggtaaaaaatggaatcactggcctcgctctataaaaatcatatagctaccttacaagaacggactcgcgatgcgctggcgcgcttcaagctggatgcgttacttattcactccggcgagctgttcaatgtttttctcgacgatcatccctatccgtttaaagtgaacccgcaattcaaagcgtgggtgccggtaactcaggtgccaaactgctggttgctggtggatggcgtgaacaagccgaaactgtggttctatctgccggttgattactggcacaacgtcgaaccgctgccgacctctttctggactgaagatgtggaagtgatcgcgctgccgaaagccgatggcattggtagcctgctgcctgctgcgcgcggcaatatcggttatatcggtccggtgccggaacgtgcgctgcaactgggtattgaggccagcaacatcaacccgaaaggggttatcgactacctgcattactatcgctccttcaaaactgagtacgaactggcctgtatgcgtgaagcgcagaaaatggcggtcaacggtcaccgcgcggcagaagaagcgttccgttctggcatgagcgagttcgatatcaacattgcctatctgaccgcgaccggtcatcgtgataccgacgtaccttacagcaacattgtggcgcttaacgaacacgctgcggtactgcattacaccaaactggaccatcaggcaccggaagagatgcgcagcttcctgctggatgccggggcagaatataacggctatgcggctgacctgacccgtacctggtcggcaaaaagtgacaacgactacgcgcagctggtgaaggacgttaatgatgaacaactggcgctgatcgccaccatgaaagcaggcgtcagctatgtggattaccacatccagttccatcagcgcatcgccaaactgctgcgtaaacatcaaatcatcaccgatatgagtgaagaagcgatggtcgaaaacgatcttaccgggccgtttatgccgcatggtatcggccatccgctgggcctgcaggtgcatgacgtcgctggttttatgcaggatgatagcggtacgcacctcgcggcaccggcaaaatatccgtacctgcgctgcacccgtattctccagccgggcatggtgttaaccatcgaaccgggtatctacttcatcgaatcgctactggcaccgtggcgtgaagggcagttcagcaagcacttcaactggcagaaaattgaagcactgaaaccgttcggcggcattcgtatcgaagacaacgtggtgatccacgaaaacaacgtggaaaacatgacccgggatctgaaactggcgtgatggaaagctggttaattcctgcggcaccggtcacggtcgttgaagagatcaaaaagagccgcttcataacgatgttggcgcataccgatggcgttgaggcggcgaaagcgtttgttgaatcggtgcgggcagaacaccccgatgcccggcaccattgcgtggcgtgggtcgcgggtgcgccggatgattctcaacagctgggtttctctgacgacggggagccggcgggaacggcaggtaaaccgatgctcgcccagctaatgggcagcggcgtcggggaaattaccgctgtggtagtgcgctactacggcggcatattgcttggcaccggtgggttagtgaaagcgtatggcggcggcgtgaatcaggcgctgcgccagctaacgacccaacgcaagacgccattaaccgaatatactttgcaatgtgaatatcatcagttaaccggcattgaagcgttgctggggcagtgtgacggcaaaattatcaacagtgattatcaggcattcgttctgctgcgggtggcgcttccggcggcgaaagtggctgaattttccgcaaagctggcggattttagccgtggttcattgcaattgttagcgattgaagaataatccccacttcgttttgcagaactaaggaagcggcagagatgcattttcgcgccattacccgaatcgttggactactggtcatcttattttcagggaccatgattatccctgggctggtagcactcatctaccgggatggagcgggccgcgcttttacccagaccttttttgtcgccctcgccattggctctatgctgtggtggccgaaccgcaaagagaaaggcgaacttaaatcccgtgaggggtttctgatagtggtgctgttctggaccgtgctgggtagcgtcggtgcgctcccttttatcttctcggaaagcccgaacctcacgattaccgatgcgttttttgaatctttctctggcctgaccactacgggagccactacgctggtggggctggattcgctccctcacgccatcctcttttatcgccagatgctgcaatggtttggcgggatggggatcatcgtgttggcggttgcgatactgcctatcctcggcgtgggtgggatgcagctctatcgcgcagaaatgcccggcccgctgaaagataacaaaatgcgcccgcgaattgcggaaacggcgaaaaccctgtggttgatttatgtcttgctgaccgtcgcctgtgcgctggcgttgtggtttgccggaatggatgcctttgatgccatcggccatagctttgcgactatcgctattggcggcttctcgacacatgatgccagtatcggttatttcgatagcccgactattaacactatcattgctatcttcctgctgatctccggctgtaactacggtctgcacttttcactgttaagtgggcgtagtctgaaggtttattggcgcgatccggaatttcgcatgtttatcggcgtacagtttacgctggtggttatttgtaccctcgtactgtggtttcataatgtctacagttcggcgctgatgacaattaaccaggcgtttttccaggtggtgtcgatggcgacaaccgccgggtttacaactgacagcattgcccgctggccgctctttttgccggtactgcttttatgttcagcctttatcggcggttgcgccgggtcaacgggcggtggcctgaaggtgatccgcatcctgctgctgtttaagcaggggaaccgtgagctgaaacgactggtgcatccgaacgccgtctatagcattaagctggggaatcgcgcactgccggaacgtatcctcgaagccgtttggggatttttctccgcctatgcattggtgtttattgtcagtatgctggcgattatcgccacgggcgtggatgacttttctgcctttgcgtcggttgttgcgacattgaataacctggggccagggcttggcgtggttgctgataactttaccagtatgaacccggtggctaaatggatcctgattgccaacatgctgtttggtcgtctcgaggtctttacattgctggtgctctttaccccgactttctggcgtgaatgatggagtaatacgtgaaaacattaattcttttctcaacaagggacggacaaacgcgcgagattgcctcctacctggcttcggaactgaaagaactggggatccaggcggatgtcgccaatgtgcaccgcattgaagaaccacagtgggaaaactatgaccgtgtggtcattggtgcttctattcgctatggtcactaccattcagcgttccaggaatttgtcaaaaaacatgcgacgcggctgaattcgatgccgagcgccttttactccgtgaatctggtggcgcgcaaaccggagaagcgtactccacagaccaacagctacgcgcgcaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataagcataaagaataaaaaatgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaggcgtattatgcacaccccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcgtcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagaggggtaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgaagtgctcacacagattgtctgatgaaaatgagcagtaaaacctctacaggcttgtagctcaggtggttagagcgcacccctgataagggtgaggtcggtggttcaagtccactcaggcctaccaaatttgcacggcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgtgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagccgcaaggcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaaggtgttttggcggattgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctcctcatgcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcattggcgcagaaaaaaatgccggatgcgacgctggcgcgtcttatccagcctactcttgcttatccgttctgcttttgcatccactccaccacaaaatcagccagcccctcaacatcattaatatccagtaatgcgacatcaagattaagcggcacatcactggctacagcaataacatgcctgtctatcactaattcttcaggtcgatgtccggctccatcgcgaaacagcacaatctttgcgatctcttcatgcttaaacccttcgaccagaatcaaatccagctttgaggtatccattcgacttgcgagaaactgtagatccagctcttcttcgtctggtgtttccgtcatcaaggcccatcgttgctggctggcaacgatggtttgtgccgcgccagccttgcgcagctcatagctatctttgcctggcttatcaacatccatatcatggtgcgtatgcttaatcagccctggacggatccctctggcgcataatgccgggatcagttttttcaaaagcgtagtttttccggtaccactccacgcggcaaaggcgagtaacggtatcatcgtttttcctgccatcgggcaagctcctctggcgtattcacgttaacaaatgcatctttatgatcgctgaaatcaaccgcatgaccgccagccagacgcataaataccattacccggcgttctcctgcttgcagatattccagtaataaaggctcaatagcgcggtttaccagagcaatagtcgggtgatcgcgttcaccgtcatggacccacacgacaggcgcatctttgcgctgatgattaagcctggctgctaaatcagggggaatgtaaggcgtatcgcacgggcaaaacaaaaaccactcaccagcttcctgctgcattactgaaagcattcctgccagagggcctgggtaatccgccagtgaatcttcaatcactttcagaccgcttgcctgatagatttcctgatgacgattagcattaaccacgacgtgagagagctgcgtcataagcgcgtcagcgacatgttgccataatggtttgccgtttaattcaagcaatcctttatctacgccgcccattcgtctggctttaccgcctgccagcacaacgcctgttatcgtcgtcatcagattcaccgatatcgcctcttttattgtgggattgaccctgctaacgtgtctgtctcaagagtaaggagcatcactatgaaatgtaaacgtctgaatgaagttattgaactcctccagccagcctggcaaaaagagccagaccttaacctgctgcaatttttgcagaaactggcgaaagagtcaggttttgacggcgaactggcggatttgacggatgacattctgatctatcacctgaaaatgcgtgattccgcgaaagatgcggtgatcccgggtttgcagaaagattatgaagaagacttcaaaacggcgctgttacgcgctcgcggcgtaattaaagagtaaaagcttgtaagcggcgccaccaaaatcatcgtgaaatgatatccttcgtcattcgtaatgttttccggatgatgggatgaataacagcgcttttactttccagacactacacccggataccatcatggacgctctgtttgagcatgggatccgggtggattccggtcttaccccgcttaacagctatgaaaaccgtgtctatcaatttcaggacgaagatcgtcgacgttttgtcgtcaaattttatcgccctgaacgttggacagccgatcaaatcctcgaagaacatcaatttgcgttgcagctggtaaatgatgaagttccggtcgcagcacctgtggcctttaacggtcagactttattgaatcatcagggattttatttcgctgtttttccaagcgtcggtggtcgccagttcgaagctgataatatcgatcagatggaagcggttgggcgttatttagggcgtatgcaccagacggggcgcaaacagctttttatccatcgcccgaccatcggtttgaacgaatatctcattgagccacgcaagctgtttgaggacgctacactgataccttccgggttgaaagcggcattcctgaaagcgacagatgagctgattgccgccgttacagcacactggcgggaagatttcaccgttctgcggctacatggagactgccacgccgggaatattctctggcgcgatggtccaatgtttgttgatctggatgatgcacgtaatggtccagccgttcaggatttgtggatgttgctcaatggcgataaagccgagcagcggatgcaactggaaactattattgaagcttatgaagaatttagcgagttcgacaccgctgaaatcggactgattgaacctttacgcgccatgcgtttggtttattatcttgcctggctaatgcggcgttgggctgatcccgcgttcccgaaaaatttcccgtggttaaccggggaagattactggctgcgacagacggcgacttttatagaacaggcaaaagttctacaagaaccccctttgcaattaacacctatgtattaatcggagagagtagatcatgaaaaagatttggctggcgctggctggtttagttttagcgtttagcgcatcggcggcgcagtatgaagatggtaaacagtacactaccctggaaaaaccggtagctggcgcgccgcaagtgctggagtttttctctttcttctgcccgcactgctatcagtttgaagaagttctgcatatttctgataatgtgaagaaaaaactgccggaaggcgtgaagatgactaaataccacgtcaacttcatgggtggtgacctgggcaaagatctgactcaggcatgggctgtggcgatggcgctgggcgtggaagacaaagtgactgttccgctgtttgaaggcgtacagaaaacccagaccattcgttctgcttctgatatccgcgatgtatttatcaacgcaggtattaaaggtgaagagtacgacgcggcgtggaacagcttcgtggtgaaatctctggtcgctcagcaggaaaaagctgcagctgacgtgcaattgcgtggcgttccggcgatgtttgttaacggtaaatatcagctgaatccgcagggtatggataccagcaatatggatgtttttgttcagcagtatgctgatacagtgaaatatctgtccgagaaaaaataattcaatgtaaattacataaagcccgtgaatattcacgggctttttttattatttaataaatataaatacattctgataatgcatcctgccgctggacattatttcagcataagtggatattcaaagttttgctgttttatcagggaatatttatatgatacgtaagtcagctacaggtgttattgttgcgttagccgtaatctggggtggtggcacatggtacacaggtacgcaaattcagcctggtgtcgaaaaatttattaaagattttaacgatgctaaaaagaaaggtgaacatgcctacgatatgacgttaagttatcaaaattttgacaaaggcttttttaattcccgttttcaaatgcaaatgacattcgataacggtgcacccgatctcaatatcaagccaggccagaaagttgtatttgatgtggatgttgagcacggtccgttgcccatcacaatgttaatgcatggtaatgtcatcccagcactggcagcggcaaaagtgaacttagtgaataatgaactgacacaaccgctatttatcgccgcgaaaaataaatcgcccgtggaagcgacattgcgattcgcgtttggtggctcattctctacgacattagatgttgcccctgcagagtatggaaagttttcttttggtgagggccagtttacttttaatggtgatggtagttcattgtctaacctggatattgaaggcaaagtcgaagatattgttctgcaattatcaccaatgaacaaagtaacggcaaaaagttttaccattgattctctggcgcgattagaagaaaagaaatttccggttggtgaaagcgagtcgaaatttaatcagattaacattatcaatcacggggaagacgttgcccaaatcgatgctttcgttgcaaaaaccaggctggatcgcgttaaagacaaagattatatcaatgtcaatctcacctacgaacttgataagttaacaaaagggaatcagcaactcggtagtggtgagtggtcattgattgctgaatctattgatccctcagcagtgcgccaatttatcatccagtataacattgcgatgcagaagcagcttgctgcacaccctgagttagcaaacgatgaagttgctctgcaagaagtgaatgctgcattgttcaaagagtatttaccgttattacaaaaaagtgagccgaccattaaacaaccggtaagatggaagaacgcactcggcgaactaaatgccaatctggatatcagtattgccgacccagccaaatcttcatcatccacaaacaaagatatcaaatcgctcaattttgatgtgaagttaccgcttaatgtcgtcacagaaaccgcaaaacagcttaatttatctgaaggaatggatgcggaaaaagcgcaaaagcaggctgataaacaaatcagcgggatgatgacattaggtcagatgtttcagttaatcacgattgacaacaataccgcctcgctgcagctgcgttatacaccgggtaaagttgtttttaacggacaggagatgagcgaagaagaatttatgtctcgtgccggacgttttgttcattaaaatactcactcgcctctgctcattcagaggcgagtaaaacttacttattctgacgctgtgatgacatgagagacgtcagaagccggtctttttcctgccacaatgagttcagccattgctgaaaatggcgcttaaagcttttgtcattgatgtagtcgccatgtaactcatcggcaataggctgtaaatccacatgtacgacaatccgcgtcagtttaccgcttaacatatcgaagaacggctgacggttattgtccggataacacagcgtaacattaagcagtttatcgaattgtttacccagtacatttagcgccatcgcaatgcctgccgcctttggtggcaacaagttttgaaaagtggagtgggtttgctgatgtttttcttgcgtgaaacgggagccttcaacgaaattgacaatggtggtgggatgcaggcgaaacttttcacaagaacgccgagtggtttcaacatctttaccacgtcgctccggatgacgtaataaataagcgcgggaataacgcttcataaacggcatatccagcgaccagcacgccaggccaagaaatggcacccaggccagctgttgcttgaggaaatatttattcatcggaatgtgcttacgaaacagcacgcacagtacgacaatatctgcccaactacggtggttacaaataagcagataccagttcttcttacttaacccttccagcccgtgaacttcccattgaaggtgtgggttcagatgcagtaataccgccagaccttcacaccagcaatacatcataaaatcacaaaaacgcgaaacctttcgccaaatgactggcacaggtagcaatagttttacaatcccggcaatgatgatcgggacggaacaaaaaatagtgaccaaaatggtcaatacgatactcagcaaaagggttatcgcagcgagtattctcgtcataatgaatttattcaaaaggttagccatagacagtgcgctaaagaagcgcaaggcgcagattttagcagaaaacgacccaaataacggatgatccttaaggagaaaaataattcatatctatccacattagaaaaaatcccattatctcaattattagggatggatttatttttaactgcatgaaaaacaaagacaaacatcatgctgtaaaaagcatgataataaattaaaagcgatgtaaataatttatgcacaaagttatccacatgacgatttgcgagcgatccagaagatctacaaaagattttcacgaaaagcggtgaaaaactcatgttttcatcctgtctgtggcatcctttacccataatctgataaacaggcacggacattatggttcagatcccccaaaatccacttatccttgtagatggttcatcttatctttatcgcgcatatcacgcgtttcccccgctgactaacagcgcaggcgagccgaccggtgcgatgtatggtgtcctcaacatgctgcgcagtctgatcatgcaatataaaccgacgcatgcagcggtggtctttgacgccaagggaaaaacctttcgtgatgaactgtttgaacattacaaatcacatcgcccgccaatgccggacgatctgcgtgcacaaatcgaacccttgcacgcgatggttaaagcgatgggactgccgctgctggcggtttctggcgtagaagcggacgacgttatcggtactctggcgcgcgaagccgaaaaagccgggcgtccggtgctgatcagcactggcgataaagatatggcgcagctggtgacgccaaatattacgcttatcaataccatgacgaataccatcctcggaccggaagaggtggtgaataagtacggcgtgccgccagaactgatcatcgatttcctggcgctgatgggtgactcctctgataacattcctggcgtaccgggcgtcggtgaaaaaaccgcgcaggcattgctgcaaggtcttggcggactggatacgctgtatgccgagccagaaaaaattgctgggttgagcttccgtggcgcgaaaacaatggcagcgaagctcgagcaaaacaaagaagttgcttatctctcataccagctggcgacgattaaaaccgacgttgaactggagctgacctgtgaacaactggaagtgcagcaaccggcagcggaagagttgttggggctgttcaaaaagtatgagttcaaacgctggactgctgatgtcgaagcgggcaaatggttacaggccaaaggggcaaaaccagccgcgaagccacaggaaaccagtgttgcagacgaagcaccagaagtgacggcaacggtgatttcttatgacaactacgtcaccatccttgatgaagaaacactgaaagcgtggattgcgaagctggaaaaagcgccggtatttgcatttgataccgaaaccgacagccttgataacatctctgctaacctggtcgggctttcttttgctatcgagccaggcgtagcggcatatattccggttgctcatgattatcttgatgcgcccgatcaaatctctcgcgagcgtgcactcgagttgctaaaaccgctgctggaagatgaaaaggcgctgaaggtcgggcaaaacctgaaatacgatcgcggtattctggcgaactacggcattgaactgcgtgggattgcgtttgataccatgctggagtcctacattctcaatagcgttgccgggcgtcacgatatggacagcctcgcggaacgttggttgaagcacaaaaccatcacttttgaagagattgctggtaaaggcaaaaatcaactgacctttaaccagattgccctcgaagaagccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgaagctgaaatcgacctacaccgacaagctgccgctgatgatcaacccgaaaaccgggcgtgtgcatacctcttatcaccaggcagtaactgcaacgggacgtttatcgtcaaccgatcctaacctgcaaaacattccggtgcgtaacgaagaaggtcgtcgtatccgccaggcgtttattgcgccagaggattatgtgattgtctcagcggactactcgcagattgaactgcgcattatggcgcatctttcgcgtgacaaaggcttgctgaccgcattcgcggaaggaaaagatatccaccgggcaacggcggcagaagtgtttggtttgccactggaaaccgtcaccagcgagcaacgccgtagcgcgaaagcgatcaactttggtctgatttatggcatgagtgctttcggtctggcgcggcaattgaacattccacgtaaagaagcgcagaagtacatggacctttacttcgaacgctaccctggcgtgctggagtatatggaacgcacccgtgctcaggcgaaagagcagggctacgttgaaacgctggacggacgccgtctgtatctgccggatatcaaatccagcaatggtgctcgtcgtgcagcggctgaacgtgcagccattaacgcgccaatgcagggaaccgccgccgacattatcaaacgggcgatgattgccgttgatgcgtggttacaggctgagcaaccgcgtgtacgtatgatcatgcaggtacacgatgaactggtatttgaagttcataaagatgatgttgatgccgtcgcgaagcagattcatcaactgatggaaaactgtacccgtctggatgtgccgttgctggtggaagtggggagtggcgaaaactgggatcaggcgcactaagattcgcctgaacatgccttttttcgtaagtaagcaacataagctgtcacgttttgtgatggctattagaaattcctatgcaacaactgaaaaaaaattacaaaaagtgctttctgaactgaacaaaaaagagtaaagttagtcgcgtagggtacagaggtaagatgttctatctttcagaccttttacttcacgtaatcggatttggctgaatattttagccgccccagtcagtaatgactggggcgttttttattgggcgaaagaaaagatccgtaatgcctgatgcgctatgtttatcaggccaacggtagaattgtaatctattgaatttacgggccggatacgccacatccggcacaagcattaaggcaagaaaattattcgccgtcctgcgtttcttctacaggctgcatctcgctaaaccaggtatccagtttctgccgcagcttgtccacgccttgtttcttcaacgaagaaaacgtttcaacctgcacatcaccgttaaacgccagtacagcttcacgcaccatattcaattgcgctttacgtgcgccgcttgccagtttgtccgctttggtcagcagcaccagaacggcgatattgctgtctaccgcccactcaatcatctgctgatccaaatctttcagcggatggcgaatatccattagcaccaccagaccttgcaggctctgacgtttttcgaggtattcgccgagcgcacgctgccatttgcgcttcatctcttccgggacttccgcataaccgtacccaggcaagtcaaccagacgcttgccgtcagccacttcaaacaggttgataagctgggtgcgccctggggtttttgaggtacgagccaggcttttctggttagtcagcgtgttcagcgcgctggatttacctgcgttggaacggcctgcaaaagccacttcaattccggtatcggaaggtaggtggcgaatatcaggcgcactcatcacaaaatgcgtctgttgataattcaaattagtcaaagcggtcgtctccgtcagtcaaagctttgtggcgattatacctgaaccataataaaaggcggatttttcggcgtgagcgttgtaagtaaaagccatacgctttgtgagacattgccgatagtctttatgcgaaatagcagagaaaattctgcgatgcatgtcaaataagctatataaatcagtgaattgcttttatataaaactctgaaaatgtgcaaatactgatggcggttgattgtttgtttaaagcaaaggcgtaaagtagcacccatagagcgaggacgctaacaggaacaatgactcaggatgagggtcaggagcgccaggaggcgaagacagaggattgtcaggaagacaaacgtccggagacgtaattaaacggaaatggaatcaacacggattgttccggctaaaggaaaaacagggtgtgttggcggcctgcaaggattgtaagacccgttaagggttatgagtcaggaaaaaaggcgacagagtaatctgtcgccttttttctttgcttgctttctgttagattccgccgcaaatctatactgaataaaacggctaaaagacgaaccattatgaaaccatcatcttcaaactcacgcagcaaaggtcatgcaaaagcgcgtcgaaaaacacgcgaggagctggatcaggaagctcgtgatcgcaagcgtcagaaaaaacgtcgtggtcatgcgccgggcagccgcgcagcgggcggaaacaccacgtcaggcagcaaaggccagaacgcaccaaaagatccacgtattggcagtaaaacccctattccattgggcgtgactgaaaaagtcaccaaacagcacaaaccgaagagtgagaaacctatgctttcaccgcaggcggagttggaattactggaaacggatgagcgtctggatgcgctgctggaacgtctggaagcaggcgaaaccctgagtgccgaagagcaatcctgggtggatgctaaactggatcgtattgatgagttgatgcagaaactcggcctctcttatgacgatgacgaagaagaggaagaagacgagaagcaagaagacatgatgcgtctgctgcggggcaactaacggattgccgccgtgggccttcccgttctgctgataacccttccggttatatgttatctggtgtggttattcgttaaactacagcggttgtcgcggcgacaaaagtggctgcgcaaccggctgatgacccgaaacgggcatccgccggtacgccgtagccgccagagacgccatcggaaggagtgagcatgtctgtacagcaaatcgactgggatctggccctgatccagaaatataactattccgggccacgatacacctcgtacccgaccgcgctggagttttcagaagacttcggcgaacaggcgtttttacaagccgtggcgcgctatcctgagcgtccattatctctctacgtacatatcccgttctgccataagctttgttacttctgcggttgcaataagattgttactcgccagcagcacaaggccgatcagtatctggacgcgctggagcaagaaatcgtccatcgtgcaccgctgttcgccgggcgtcacgtcagccaattgcactggggcggcggaacgccgacgtatctgaataaagcgcaaatcagccgcctgatgaagctgctgcgcgaaaacttccagttcaatgccgatgcggagatttcgatcgaagtcgatccgcgggaaatcgaactggatgtactcgatcatttacgcgccgaaggctttaatcgcctgagcatgggcgtgcaggacttcaacaaagaagtgcaacgtctggttaaccgcgagcaggatgaagagttcatctttgcactgcttaaccatgcgcgtgagattggttttacctccaccaacatcgacctgatttacggcctgccgaaacagacgccggagagtttcgcctttaccctgaaacgtgtggcggagctgaaccccgatcgtctgagtgtctttaactacgcgcatctgccgaccatttttgctgctcagcgcaaaatcaaagatgctgacctgccgagtccgcagcaaaaactcgatatcctgcaggaaaccatcgccttcctgacgcaatcgggctatcagtttatcggtatggatcactttgcccgtccggatgacgagctggcggtggcccagcgtgaaggcgtgctgcatcgtaacttccagggctacaccactcagggcgataccgatctgctggggatgggcgtttccgccatcagcatgattggcgactgctacgcgcagaaccagaaagagttgaagcagtactatcagcaagtggatgaacaaggcaatgcgctgtggcgtggtattgcgctaacgcgtgatgactgtattcgccgcgatgtgattaagtcgctcatctgcaacttccgtctggattacgcccctattgagaaacagtgggatttgcacttcgctgattactttgcggaagatctcaagctgctcgccccgttagcaaaagatgggctggtggatgtggatgagaagggaatacaggtgacggcgaaaggtcgcttgctgatccgcaacatttgcatgtgctttgatacctatctgcgccagaaagcgcggatgcagcagttctctcgggtgatttaaatagtgaatggcgcttcgtttacaaagtagaaaacgaaagcgccatcaatgtgctgagaacaagattgcctgatgcgctgggcaacaaaacctgttgaaattattgcttttgtaggccggataaggcgtttacgccgcatcaggcatctgagcatgatgcctgatgcggcgctggtcgcgtcttatcaggcctacgactttctccgcatccggcataaacaacgagcttcagctaaacagcccaatcattgcggcacacagcacggcagcaacggcagtttgcggtgtgtggctgtcaactgcgccactcgataccagattaattattgattccagcataatgactctccccgttttccgggcaagatcatactgaacttatcggaacagtaaagcgtaaaataccagcaatttgcgctcaataatcaatctttacacacaagctgtgaatcactccatccccagctcttttaacttacgcgtcagggtgttgcggccccagccgagtagccgcgccgcttcctgtttatgcccctgcgtatgtcgcaacgcggtcgtcagtaacgtccgctccagctctggctgcgcttcggaaagcagattttgatgaccggaacgcagcgctctgtctgcccactgcgcaagaagcgtcgcccagctgtccggttgcatttgcgaagtactctccgcaaccgttgattcaaacagttcgccgggcaaatcctgaatcaacacttcctgcccggcggccatcaccgttagccagcggcaggtgttttccagctggcgcacgttgcctggccacgccagacgcgtcagagcagcttcggtttccggatgcagtaacttcgcttctacgcccagttcgcgcgcggcaacctgtaaaaaatggcgcgccagacggggaatatcttcccgacgttcgcgcagcggcggcagatgaacgcggataacgttcaggcggtggaacagatcctcacggaacttaccttcctgcactcgctgttcgagattctggtgagtggcagcgataatccgcacatccactttcaccggcgcatagccgccaacgcggtaaaactgaccgtctgccagcacgcgcagcaaacgcgtctgcacatccagcggcatatcaccaatttcgtcgaggaataatgtaccgccatcggcctgttcaaaacgcccctgacgaatggtattcgcgccagtaaacgcgcctttctcgtggccaaacagttctgattcgatcaaatcttttgggatagctgccatattcagcgcgataaacggcgctttggcgcgcggactgtggcgatgcagggcatgagcgaccagttctttaccggtgccggattcgccgttaatcagcacgctaatagaagaacgcgaaagccgaccgataatacggaacacgtcctgcatggctggcgcttcgccgatgatatcggtcgttgggccgttaagctgaacattacgcggctgctgctgttcctggtaatgactgatagcgcgctcaaccagcgccactgcttcgtcgatatcaaacggtttgggcagataatcaaacgccccttgttgataggcgctgacggcagcatccagatcggaatgtgcggtcataatgatgaccggaagcattggatggcgctgtttaatctgcttgagcagcgccagcccgtccattcccggcatacggatatctgaaagcagcacatccggcgttttgctcgccagcgcctccagcacttctgcgccgttctcaaacgtcgtacaggttaaacctgccccagcgagcgcacgttcaagcacccaacggatggaactatcgtcatcgactacccagactatccctcgttgcataaacgtcacctttatttcctgataggcaggtaaaccgagaactcggtatgccctggccaactggtaaattcaattttgcctgaatgctgatcaatcaaattacgagcgatggataagccaagcccggtgccaccttcgcggccgctgaccatcgggtaaaacagcgtatcctgcaaatgaggcggaatgcccggcccgttatcttccacatcaatccgcgccgccagccggtagcgctcgccgtgtaaggtcagttgaaacgcggtgcgggtacgcagaatgatttcaccgccttccggccccagcgcctgtagcgcattgcgcacaatattcagcaagacctgttcaatttgatccgggtcgtgcgccagttccggtaggctgggatcgtaatcacgaatcaaccgcacgttgtccggcagttccatcgacaccagcgttaccacgcgttcagccactttgtgaatactttcggtaacgcgcgtaccgggcagctgcggccccaacagacggtcgaccagatttcgcagccggtccgcctgttcgataatcactttggtatattcgagtagtgatgggtcaggtaacgctttgctgagcagctgcgccgcgccacgtaaaccgccaagcggatttttaatctcatgtgccaggccgcgcactaaatcacgggcagcaacctgctgggcgtgctgtagctgttcctgacttaagcggcgctggttatccatcggagccatctccagcaggatcatgccgtccggcatacgctgggccgtcacagaaaggatatgcgagcgcccgtcgatgaccagcgtcacttcgttatcggtaaaaccttgccccgcctccagactttcttgcatcagctcgatatttaatgagaagtagctcaacagttccggtaacggtgtaccaaacaatttgcgggagctttgggcgagcagttgttgcgcggcagggttggcgtaatggatcgccaggttgtcatcgattaacaaaatactgttaatcagcgagttgaggatctgcccagcatcgggctgcgtgcctgttgccataaagcagtctcctgaacaggttgcaccattttagtgcattatagctttttacggataaaaagcgcgaagcatcagagaattgacggagaaaaaagcccatgcagagatgggctacagatagctgacaaacttcacgttggagagcgactcacctgctccggcctaccacatcatcaccgtgtaggccggataagacgcatttgcgtcgcatccggcgtgatgtgcttgccaccgatcccaggcctgccagagacaggcgaaaagtttccacggcaactaaaacacttagacgctgtagtacagctcaaactctaccggatgcggagtcatacgcacgcggtcatcttcttcgcgacgcagagcgatgtacgcatcaattgcttcgtcagtgaacacgccaccggctttcaggaactcgcggtccagatccagttcgttcagtgcttcttccagagagcctgcaacctgtgggatctctttcgcttcttctggcggcaggtcatacaggtttttgtccatggcttcgcccggatggatcttgttcttgataccatcaagaccggccatcagcagggcagcaaagcacaggtacgggttagctgccggatccgggaaacgtacttcgatacgacgtgctttcggagaagaaaccaccggaatacggatagacgcagaacggttacgcgcagagtaagccagcattaccggtgcttcatagcccgggaccagacgcttataagagttggtggtcgggtttgccagggcgttaatcgctttagcgtgtttgattacgccgccaatgtagtacagcgcctgctcagacagacctgcgtatttgtcgcctgcgaacaggttaacgccgtttttagacagagacatgtggcagtgcataccggagccgttatcaccgaacatcggttttggcataaaggtcgcggttttaccgaagcggtgcgctacgttgtgcacaacatatttgtagatctgaatttcgtcagcttttttggtcatggtattgaagcgggtagccacttcgttctgaccagcagtcgctacttcgtggtgatgggcttcaaccaccagacccatctgttccatcaccagacacatttcagaacgaatatcctgagccgagtctaccggtggaaccgggaagtaaccgcctttcactgccggacggtgacctttgttaccaccttcgtattgggtggaggagttccatgcgccttcgatatcgtcgatagcaacgtgggaaccggagatagatgatccgaaacggatgtcatcgaacaggaagaattcaggttctggcccgaacagtacggtgtcggcaatgccagtggaacgcaggtaatcttcggcgcgcttcgcaatggagcgcgggtcacggtcatagccttgcagggtgccaggttcaaggatgtcgcaacggataatcagggtggagtcggcgaagaacgggtcaatcactgcggtggatgcgtctggcatcagcaccatgtcggactcgttaatgcctttccagccgccaatcgaggagccgtcaaacattttgccttcttcgaagaattcagcattcacctgatgagcagggatagtgacgtgctgttctttacctttagtatcggtgaagcgcaaatcaacaaacttcacttcgtgctcgttcagcatcgtcagtacgtgttcagcggacatactttaactctcctggattggtcatggtcgtcgtggtaacgaaatctgcaattattttggccgtgtcgccgtaaaaaagataaagcgaaatctgtgccaacttttaaattgcccctaaaaggcgttatcatgcgcaccatcgtgcaaaagggctgcaccacgatgtgaatgttgcaccaatatagtgcttcaatggaaacattaagcaccatgttggtgcaatgacctttggataaccctttttatgctccgtgaaagcgatcacaaagggactctgcaatacttgtttgcggaggatgtttgtgatcctgttttgtagtgcgattaatccgtgtacaataacgcgctatttctaatgcctgaggcaaagttgtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtaccaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggtcactatcatcgatagcgaaggcaaaacccgcaacgcgaaagtcggtaaagtgctgggccacctcggtctggaacgtatcgaaaccgatctggcggaagctggcgatatcgttgcgatcacgggccttggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaagttatcttccgtgaaatcgacggtcgtaaacaagagccgtatgaaaacgtgactctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtactggtctgctgtactccaccttcagccactacgacgacgtacgtccgggtgaagtgggtcagcgtcagaacggcgtactgatctctaacggtcagggtaaagcggtcgcgttcgcgctgttcggtctgcaggatcgcggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgactccgacctctatccgtattcgtaaacgtcacctgacggaaaacgatcgtcgccgcgccaaccgcgcaccgaaagacgattaatttcgttttttagtcataaaaaacctgccagcgatggcaggtttttttttgcctgtcgtgagcgcacaccaatgcgagtatctcccttataagtctgtggttacgtcaatagagagctttgtcacaattatctgcaaagtcatacgccgttaattgctttcttttttggcgtaagcgtaagatgcttcatctggtttaaaccaaaaggattaaacaatggcggagaatcaatccaccgtagaaaatgcaaaagagaaactggatcggtggttgaaagatggcatcaccacgccgggtggaaaactcccttcagaaagagagctgggagaactgctgggcattaaacgtatgacgctgcgccaggcgttgttgaacctcgaggcagaatccaaaatcttccgtaaggatcgtaaggggtggttcgtgacccagccgcgatttaattacagtccggagctgtcggcgagctttcagcgggccgcaattgagcaagggcgagagccttcctgggggtttaccgagaaaaaccgtaccagcgatattcccgagacgctcgcgccactgattgcagtgacgccatcaactgaactctatcgcatcaccggctggggggcgctggaaggacataaagttttctatcacgaaacatatattaatcctgaagttgctccgggctttattgaacaacttgaaaaccactcattttctgcagtctgggaaaagtgctaccaaaaagagacggtagtaaaaaaattgattttcaaacccgtcagaatgccgggcgatatcagcaagtatcttggcggttctgcgggtatgccagcgatcttaattgaaaagcatcgcgccgaccagcaaggcaatattgtccaaatagatattgaatattggcgatttgaggccgtagacctcatcattaatctgtaggtgttttatggtgacaataaataacgcaagaaagattctacaacgtgtcgacactcttcctctttatttacatgcttatgcctttcatttaaatatgcggctggaaagagtgttgcctgctgatttacttgatatcgcaagtgaaaataatctacgtggcgtcaaaatccatgttctcgatggcgagcgtttttctcttggtaatatggacgataaagaactctctgcctttggggataaagcccgccgtctgaaccttgatattcatattgaaaccagcgcctcagataaggcatctattgacgaagccgtcgccatcgcgttgaaaactggggcatcgtccgtacgtttttatccacgttatgaaggtaatttgcgcgacgtattatcgattatcgctaacgacattgcctatgtacgggaaacgtatcaggacagcggcctgacttttacgatcgagcagcatgaagatttaaaaagtcatgagctggtgtcgctggtcaaagaaagtgagatggaatctctttccttactgtttgattttgcgaacatgatcaatgcaaatgagcatcccatcgacgctttaaaaacgatggcaccgcatattacccaggtccatatcaaagatgccttgatcgttaaagaaccgggtggcctgggtcataaagcctgtatttcaggtcagggtgatatgccgttcaaagcgttattaacgcaccttatctgcctgggtgatgatgagccgcaggtgacggcatatggcctggaagaagaggttgattactatgcgccggcgttccgctttgaagacgaagatgataatccgtggatcccttatcgccagatgagtgaaacaccattgccagaaaatcatttactggatgcgcggttacgtaaagaaaaagaagatgcaattaatcagataaatcatgtgcgtaacgtactacaacaaatcaaacaagaggcaaaccatcttctgaaccactaataagttttaactcatacgcagttaataaaaccattccatatgaatggtcggtatcttattgcctttaaaacagtgattttaaaaatcgcttaggggatgttatgctcacgaaaaagaaatgggcgttatttagtctattaacactgtgtggcggtacaatttataaattaccgtcgctgaaagatgcgttttatatcccgatgcaggaatatttccatttgaccaatggtcaaattggtaatgctatgtcggtaaactcatttgtcaccacagtgggcttttttctgtctatttattttgccgataaactaccgcgcagatacaccatgtcattctcactcattgcgacaggattactgggtgtttatttgacgacaatgccggggtattggggcatcctctttgtctgggcgctatttggcgttacttgcgacatgatgaactggccggtcttgctcaagtcggtaagtcgattgggcaatagcgaacaacaaggtcggttgtttggcttcttcgaaacagggcgtggcattgtcgataccgtggtggcattttctgcgttggcagtatttacctggtttggcagtggcttattaggttttaaagcaggcatctggttctattcccttattgtgattgccgtaggcattattattttctttgtcctgaatgacaaagaagaggcaccgtccgttgaggtgaaaaaagaagacggagcatcgaaaaacaccagtatgacctcggtgctgaaagacaaaactatctggcttatcgcttttaacgtcttcttcgtttacgcggtttactgtggcctgacattcttcattccattcctgaaaaacatctatctattgcccgttgcgctggtgggggcttacggcatcattaaccaatactgtctgaaaatgattggtggaccgattggtggcatgatttcagataagatcctgaaatcgccaagtaaatatctatgctacacctttatcattagtaccgctgcgctcgtactgttgattatgctgccgcacgaaagtatgccggtctatttagggatggcatgtacgctgggctttggcgcgatagtctttacacagcgagccgtattttttgcacctatcggcgaagcaaaaattgctgaaaataaaacaggtgcggcgatggcgttgggtagctttattggttacgctccggcgatgttctgcttcagtctgtatggctacattctggatttaaatccggggattattggctacaaaatcgtgtttggcattatggcctgcttcgcattcagtggtgcggtggtttccgtaatgctggttaagcgtattagccaacgtaagaaagagatgctggcggctgaagcttaattaatggccggatgtgcttaatccggccaacgaaaaccgtatcaaccgtaggccggataaggcgtttacgccgcatccggcagtttcacatcagaagaaatacttcgtcccgatacggatctggttttgctcgcggtggtacggttcgacgttgcggtctaaccagcgcaattcgaaataagggagccagtgttcattaatacggtaacggaaggtgttagtgatttcccaatgatgatctttcccgttgctactattaaagtcattcactcgcatgaagtaatgtggctcaaatgtataggaaaatttatcggtgattttaaaattccagtaggtgccaatttcataggtgtcattattatccagttccccgctcaaatctgttgaactatagttattatggttatagcgatttcgtactgtcagattaaaccatggtacaaatttatagttgacgtccagatacactgcaccacccgaaccgatactcttatcattaattaagccaccgggctggatggttaatttatcggttggtttaaataacggataccagccttcaatttcgttatatccatgttttagttcatcttctcgctgaaagttgtaggtattggttaacataatacccgcgcccatatcgaagttataacccacacgtagcataacctcgccctgatcggaggcaagattatatgcctccctgttttcgacgtatgcgccagcaaataccgaggcagaggtcagagaagataataaaattattgcattaatctttttcataataagtccattttttaaacgtagggaggccgccacccaccaggatggaaatagcggctattgacatttataacgttacggaagccgttttttcttctgtcgccatctctttatttttgcgttggttgatttcctcaataatcaatgcaaaccgtttttcattgagtgtgtaaaagaatcccatcgtcaatgcagcaataattgccagtgcacaaggccagataaaaatgagctgacgcaaaccctgtaatgtcgcatcgctttgcgcgatgttgggaacataaccaatttgcgtcagcataatgcctggcaagaagccagcaagtgcggcagaaattttacgaaagaaggtataaccggtataaacagaaccttcggcacgaataccggttttccattcaccgtaatctacggtatctggtaccagtgcccagttcaggctgtttacaaaggccgtgccaaaaaaggcgacacaagagaacatgacgaaagtgaaagagttacttccccagaaataattcagtatatcacccaccgcccacagcaccatgccagccagataaacctgttttttaccaaaacattttacagttaatggcaccagtaatacgccgatgaggatgcatcccatactgaagaatcccatccacgacaataaattaatatcattcagcacatactgggtgtaatagacctgaatcgccagtttgatattaaatgccgccagggtacacaagttagcaatgcataaaaccagcaatggcggattccgaaatatcgcgcaaaatgatttgagaatactggctttatgtccggttggcgttgtgtccacataatgctctttgacgcctctgtagcacagcatcataaaaataaagccgccaatggagaacataagtgccgcacaggcataaccgacggttgagtcagaaaaaagcgactgcaacggaataaacgccacggtacaaatcaatagccctatggttgcaccaccctggcggtaagccgcgagctgcgcgcgctcattcgggtttttggtaattgccgggatcatcgcaccatacgagcagttcatcagactgtatgaaagtccaaacatcataaacagcgcggtggcaatcgtcgttttaaccggcaaacaaaaggtggtggcgataaactggagcgttgcaattaacgccgccggaaccgctgcatataaaataaagggacgaaatttgcctttaggcccaatatttttccgcgagtcgagtaaaaatccggtgagcatatcggtaaacgcggtaaaaaacttcgccaccagaaagataatcccgccatagtaagcaggcatccctaattcatcggtataaaatttgaggagatacagagtaccgatgcagagcattaaattcgaaccgacgtcgcccataccataggcgattttttcccgcagattcagttttaatgtcagtggattatggtcagacataatcactccttataacgccccgcagggcgtcgtttattattattacgccgtgcgtttacgggcttctatctcttccacaatgcggacatacatcttctcgttcaggctgtagaagcaacccatcgccacaatggtgactaccgccagtgcgcttgggtagatgaagatcaactggcgtaacccttcaatggtgtggtcagcctgtgcgacgttcggcacatagccaatttgcgtcagcatccagccggggaagaaaccagccagcgcctgagacactttgcgaaagaaggtaaaaccggtgtagaccgttccttccgaacgcacgccggtgcgccactcgccgtactcgacggtgtcggaaaccagcgcccagttcaggctgttaacaaacgctgagccaaagaacgccaggcaggagaacgccacgaagctgaccgaaccgccgccgaagaaatagttgagcagatcgcccagcacccaaatcagcaggccgccgatataaactttcttcttgccaaaacgtctgactgaggcaggcatcaggaatacgccgatgaaaatacagcccatgctgaaaaatcccatatacgacaacaggatgggatcgttaagcacgtactgggtgtaatagacctggatggcgagcttgacgttaaacgcccctaaagtgcagaggttggcaatgcacagaatgaacagcgggcggttacccgcaattgcgcggaaagattgcagcaggcccggcttttgcgccggattagcaggctgggtttcgacataacgctctttcacgcccgagtagcagatccacataaacagcaggccaaacagtgaaaacagcgtggcggcgaagatatagccaagttgctgattaccttcgataagattcataactggcacgaatcccaccgtgcacagcagcaggcccagcgtagcgccgccctgacgccatgccgccagtgaggcgcgttcgttggggtttttggtgatagcgggaaccattgcgccgtaggagcagttcatcatgctgaaaaacagtccgtaaagcataaacagaatagtggccatcaccgttttaccggtgacatcaaacggtgtgccgacaaagttggcgatcgccagtaaggtgaccgggaatgacgcatacagaataaaaggacggaacttaccttttggaccgatcttgcgtcgggaatccaacataatgccggtacccatatcggtaaacgcagtaaagaattttgaaatcaaaaagataatgccgccataggtgcctggcagccccagaacgtcggtataaaacttcaaaagataaagcgtaccgatatccagcaggatgttagaggccaggtcgccaataccgtaagagagtttctctttaaagggcaggcgtaaagttgctggatcttccgttgtgatgtgactcatcgatgttctccctttgcccatgagtttccccacgggcggatgtgattagatgctttttaacgacgcgaacagtgccgcccattcgctatcggcgcgataaaagaccggcggcttgccgatgggcgcattaacggtaacttccccgccccggaacgcttcacccgtccaggcgtggacccagttatcctccggcagatagagcgtccagtcgctacggccttcttcatgcaccggagcgaccagaatgtcgcgacctaacaggtactgatatttcagggtgtaagtgtgcgcatcgtcttcgtaatgcaggaacagcgggcgcataaccggcaggccggacttcgcattcagcgcgacggcctctttcaggtaaggtttcagggtggtgaagacggtggtcatacgggcgaaatgggcgatggtttctgcgtcgccgtcaaactgccagttgtcgccaggacggttaccttcgtgggtgcgcatcatcggcgtgaaggcgctgaaatcgcaccagcgcagcagcagctctttgctgcgcttcatctcaaacagggtggtgtaaccgccaatgtcgctgtggtgcaggccatgtccggtcattgccagcgacagcgccgccgggacaaccgacgccaggccatcgtcgagactccagtcgacgttctggtcgcccgcccacatcatggtggagtatttctggctaccggtagaaccggcgcgcataaagaaaaggatctcgccgagcttgcccgtttcttcaagggcttcgtagttacacttcgcccacagcgcaggccaggcgttatgcataatttcggcactgacgccgttatgcaagtacgtgtcggtgggcagatactcgccgaagtcagccatccagccgccgcagccgagttcaatcatgttctttttgatcacttccttgaaccaggcgtaggcttctggattagtgagatcgacaacgccgccgtaaaactcgccaaactccaccagatagtcaccgccagaggcatcttttgccagatagccgtgttgtgccgcttcttcgcagagatctttatcgctggcaacatacgggttgatataggccaggaactgcacgccctcctgattccactgcttaatgcgtgaatccagttgcgggtagttttcgctgttccacttccagttccacatcacgcgtttgccaaaagaggtcatacgaataccggaccagtcctgcgcccagatgccgttgaccttcacgcccgcgttacgcatggtgtccagtttcttctggcacacttccgtcccgccctgaatgccgagcgttactccgtcataaatccagtcgggcagttctggctggcgtcccagcagggcggttaatttttccagcagggaaatgtatgtgtcagcacattcaaaacgcagcgttgctttgtcttcccacagcgccagttcatggtattccggggcactaaagtcgaagttcatatagcaactgttatcaacatggcagtaatacttctgcgtgctgacaaacgtaggctgtgggaagaaagtccagtaatagtcgccgcccgcattttctttgcagtcggcctgccaggtgacataggtttgtttgttgcgaccaacgccttgttcactggtccatagcgggaacggtttgccacgcagatcgaagtaggaaaactgttcgccgcagccgtagatatggtcctctggttgagcggcaaggcgcagccagatacggttgtggttaaggttgtcgttttgtagttccagcaataaacgcccctgatcgtcggcagagatattcagcgtggcgctaatgtcagaaccacggctgaaatgaattaaccaaccatccggtgactggctgacgatggcgtcggtaagcgcaattttctcctgtagtttatctttaatgctgaaattaccgcggaacatatcgatatccgctatacctgagccaatccataaacaaggattatctttgctatgggttaaaataagacgttgttgaaaatgtagggtaaaactgtcgttattctgatgaaattgaaaatctaataactgtggacgtggcgtatccataactaatctccatagagttgagaacgagattgttgccttcctgttattacaggcttatgtaaaatgattctcataaaactgatatataaaaactttacagaagctgagctgtttttaacttaataaattgaagatacataatgttgcctttagcgagtgaaatgttcttcaatgattttgactgctaatcaatacaagttattttctctgtccgtaaatattaaaaaacaggcggtgcggttttcctgattccagtaataataagtcgatacctgaattaaaggcgttaggcgggcaactcataggttcaactgccagtccctgacgctgtaatttttcaccgctataaacctgcacccagagttgatcggaacaaaggcttaccgaaagcgcctgctgtggatgggtaatggtcatttcccacaaatcattagcggttttaaaggtgtggtcgatttttgtcgcggctatttttttcgcctgcgtgaaatttaaatccagctcatcaacgtggtgaagcgttgtcggattcgcgtgctcatcgacggcataaacctggtttgccggaagctggaacagatattcatcaacagatgttaagttgcaggttaaataaggatgaatacccacgccataaggcgctgcgacagtgccgatattctggcttgcgatctcaacggaaagacccgtgtgtgcgttgagcgaataaacaacttgtgaagccagcataaacggatagccgtaactgggcggcagaaaagctgtcagggtaacgctggtggcggttaattcactaatttgccagtctcgccaggcaagcagcccgtgaatagcggcttttgaactatgttcattaatgggtaactgatattcctgcccctgatagcggtaacagccgttggcgatccggttcggccacggaataagcactttacccagatgcgccagcggcatctcttcgggtttgtgcgggatgactaaatgacaaccctgaaaggttaattcagccagaccagcaccgacggtcacaatggtcgcgtgataatcccccgcggcaagtgaaacggtctgtccactgcaatgcatattggtgatttgcatacaaggcaccttaattaacgacatacagcctcccgtgaggctgatgtcaaacccaaaaactgcaccggacggtcccctcgcccctttggggagagggttagggagaggggaaaacccgcaccctattttcagatcagttatttcgcattaatatccagcagacccgctgcaaccgctggagccatgccgggcgctaacgggatacgcgggatcaccaggcaatgcagcaggtgataaatatcctgtttgccgtcccagactttggtggtgaccttattgtccgcatccagctcctgccaccaggaaccattttcatagtccatcaggtacttaatgcagtactcccaccatgtttgataccaggtttcatactggcgatcgccagtgacggtgtagagcgcgtaggccgtacccattgcttcgacgataggccaacgtacacgttcgcggaccaccggttttccttcccagtcaacggtataaacaatcccgtccgcgccatcgggtgcccaggcatcgcgcacggtggcgttaaacagacctttggcatcttctagcagccatgctggtggttgttcgcaacgggcttccagggcagcatggatgtgcagcattaaacggccccattcgatccagtggcctggtgtacctccgaacgcgcggaagcgatgcgccgggttatctttgttgtaatccggcagcggattccactgggtatcgaagtgttcgttaacgcgataatgattatttctggcgacgtcgtggataatcacggaagccacgcgaatcgcgcgatccagccattttttgtcgtgagtgacgtcataaacaatcaagaaagcttccaccgcgtgcatattggcattgccgccgcggtactcttcggttttgctgaaggcttcgtcccaggattccaggcacatctgctcttcttcgctccagaaatatttctcgataatttcaatggtgtaatcgagcagcttgcgcgcttccgggtgacccgttgtgacggcgctggcggcacccagcagagcaaagaagtgttgatagccctgtttggaggcatccaccacgccctcgtcattcacgcaggcataccagccgccatattttttatcacgcagtgcgccgttcatggctttgataccgtgatcaaccaacgagtaagcgccaggtcgacccatcgccgcagcaacggaataaacgtgcaacatacgagcggtgatccacagatgggtgcccatctcttctttgatttgccctttattgcctaaccagccaaaaccagtcggcactacggaatttttaccaaaatcaaagatgcggtcggtttcctgttccagccaacggttgtggcttagggtgttaaaccatttcattccttttatcctcatcttagcggcgtttagccatcatttcgtcgacgatatcgccaagttgttgtaatttcggtgcgcaaacgtcacgcagcatcagctcgttgtctggtaaaccgacgaccgatgcccagactgcacggcctgccaggaatcccgatgcgcccgccgtcattgccacgcgtacggcacgcgggaacagtttttcgtcgacaccggaagagaggatcacccatggcatattgatatggtcattcagacgttgtgaagcacagagaagctcttgttgcggacctttgccataaagcggcatttcaactttgtagaggtcagcgccactgtcgcccagctctttggcggcatcgatgatcgcttgttcgcgatcgaatttatcgccacgacgcggtgggcggacgactggctcaatgatgcttaccagaccgtgtgagtggcacagttcgttgaactctttcaccatatccagacgttgctgcgcatcttcatcactacgccacagcaccagcagttttaaggctttgccaccgtcttgtttgatctgtagcggattgattttgcggtcaataaccacgctatcgaccggaataccgttgccaggaatgaactcatcggcggcgacaatcatggcgcaacttttggcaatcgcgttttgctcaaccacctggcggtagcagaattgttgatctaccagaatcgccgaggcataaggcgagagggcctttgcagcgttaactttgaaatcagttaaaacgctatcggctaccggagcgggtgccccagccgcggcaaacatcatgcgcatggcttcgcgctgatcgaccgccagcatggcaaaaccgcccgatgcgcgcgtaatgtcgttgatggtgtacttattcattcatttattcctttatccagtcgttacatttttactttggcagtcatcccggcactgacacggacctgttccagaatggcggaccagtcctggcgaccgcgacccgctgcgcgcgcctggctataaacctcccgtgaggcggcccccagcggcattggcacatgcagctggttggcgacatcaagggcgatgccaagatccttatgggcaagatcgatcatgaaggcgggagaaagatctccgctgaggactttgtttggccaggaagtggtgaagtgacctttaccggcggcggtaccgctcatcactttgacggcaacatcgaagggaagattcagggcttcgcacaaaacggcggcttctgccgaaagcgcattgagcgcgatgctcatgtagttgttgatgagcttaacgcggatccccatgcccggaccgccagcgttgatcaactcactgcccatcgccatcaggatcggtgtggcacgttcaacttgttcagcggtgccgccagccagcagtaacagagtaccggtaatggcatttgcagaagtacggcctaccggaacatccatcatgctgaagcctttggcttgcatatcggcaatcaatttatcggtttgcagcggatggatggtggacatatcaatgaccagcgcatcggtagataagccttcgcaaacgccgttttcaccgaacaacacgttgcgcaccagatcgccattcggcaacatggtaatgataaattcggcatctttagcggcctgcgccgggttggcggcgggagtcgcacctttgtctaccagatgccgcacagcttcggcgttcacatcaaagacgcgaagttgatgcccttgctgcaataaattgctcgccattggcgaacccatttgtcctaaaccgataaacgcgattgctgccataaccctctcctgaatacagttatgtcactttttgtcatttatgacatgctttgcttgtctgtttttgatcgtatttgtaatttatcgtcaaaaaattgacagccgtcactttttaaacaattggtgaaattaaaatgaacgcatcccaaaatgtttaaggaatgaccatgattcgtgttgcttgtgtaggtataaccgtgatggatcgcatctattacgtggaagggttaccgacggagagcggtaaatacgtggcgagaaattatacggaagttggtggcgggccagcggcgacggcagcggttgcggcggcaaggctgggggcgcaggtcgattttattggtcgcgtaggtgatgacgacacgggcaacagcctgctggcagagctggaatcctggggcgttaacacccgttacaccaaacggtataaccaggcgaaatcttcgcaatccgccatcatggtggataccaaaggcgagcggataatcattaactaccccagcccggatctgctgcctgacgcagagtggttggaggaaattgatttctctcagtgggatgttgtgctggcagatgtacgctggcacgacggcgctaaaaaagccttcaccctggcccgtcaggcgggtgtgatgaccgttctggacggggacattacgccgcaggatatcagtgagctggtggcattaagcgatcacgcggccttttcagaaccgggtctggcgcgcttaacgggcgtgaaagagatggccagtgcgctaaaacaggcacaaacgctcacaaatggtcatgtctatgtgacccagggtagcgcaggctgcgactggctggaaaatggtgggcgtcagcatcaaccggccttcaaagttgatgtggtagataccacaggtgcgggtgatgtttttcacggcgctttggcggtggcgctggcaacaagtggggatttagcggagtcagtccgcttcgccagcggtgtagcggcgttaaaatgcacacgtcccggtggacgagccgggatccctgactgtgatcaaacccgatcttttttgtcactttttgtataaaatgccagggtgatggtttttcgaggaattttcatgagccttaccgaactaaccggtaacccgcggcacgaccaactcctcatgctgatcgccgagcgtgggtatatgaatattgatgagctggcaaatctgctggatgtctccacgcagacggtccgccgggatattcgtaaattaagcgagcaaggcctgattacgcgccatcacggtggcgcgggtcgggcttccagcgtcgttaatacggcgttcgagcagcgtgaggtttcgcaaaccgaggaaaaaaaagcgattgccgaagcggtggcagactatattcctgatggttcaacaatatttatcaccattggtacgactgttgagcatgttgcccgggcgttacttaaccataatcatttgcggataatcaccaacagcctgcgtgtggcgcatattctttaccacaacccgcgctttgaagtgatggtgcccggcggtacgttgcgctctcataatagcgggatcattggcccttcagcggcgtcctttgtggctgattttcgtgctgattatctggtaacaagcgttggggcgattgagagcgatggcgcgttgatggagtttgatgtaaacgaagctaacgtggtgaaaacgatgatggcgcacgcgagaaatattctgctggtcgccgatcacactaagtatcatgcttcggcggcggttgaaattggtaacgtggcacaggtcactgcgctctttaccgacgagctgccgcccgctgcgctaaaatcacgcttacaagacagccaaattgaaatcattcttccccaggaagacgcgtagatttttgtgaccgttaacctggcttcataccttgccacatagccaaacccatcctttcccgctacagttaatttcttgtggcgcgaaaggaggcaaaaatgctctatatctttgatttaggtaatgtgattgtcgatatcgactttaaccgtgtgctgggagcctggagcgatttaacgcgtattccgctggcatcgcttaagaagagttttcatatgggggaggcgtttcatcagcatgagcgtggggaaattagcgacgaagcgttcgcagaggcgctgtgtcatgagatggctctaccgctaagctacgagcagttctctcacggctggcaggcggtgtttgttgcgctgcgcccggaagtgatcgccatcatgcataaactgcgtgagcaggggcatcgcgtggtggtgctttccaataccaaccgcctgcataccaccttctggccggaagaatacccggaaattcgtgatgctgctgaccatatctatctgtcgcaagatctggggatgcgcaaacctgaagcacgaatttaccagcatgttttgcaggcggaaggtttttcacccagcgatacggtctttttcgacgataacgccgataatatagaaggagccaatcagctgggcattaccagtattctggtgaaagataaaaccaccatcccggactatttcgcgaaggtgttatgctaaaaaccattcaggacaaagccaggcaccgtacccgtccactatgggcctggctaaaactactctggcaacgcattgatgaggacaacatgacaaccctggcaggtaaccttgcctatgtgtcgttgctctcattagtgccgctggttgccgttgtttttgcgcttttcgccgcttttcccatgttttccgacgtcagcattcagttacgtcactttatttttgccaactttctgcctgctactggcgatgttattcagcggtatatcgaacaatttgttgccaattccaacaagatgaccgccgttggggcgtgcgggctgatcgtcaccgcgttattgttgatgtactccatcgatagcgcgttgaataccatctggcgcagtaaacgagcgcgaccaaaaatttactcgttcgccgtgtactggatgattttaacgctggggccgctgctggcaggggccagtctggcgatcagttcctatttgctctccctgcgctgggcgagcgatctcaatactgtcatcgacaacgtgctgcgtatttttccgttgctgttgtcgtggatctccttctggttgctgtacagcattgttcctaccatccgcgtacctaaccgcgacgcgattgtcggcgcgtttgtcgccgcactcctgttcgaagcaggaaagaaaggtttcgcgctttatatcaccatgttcccgtcatatcagctcatttatggtgtgctggcggtgatccccattctctttgtttgggtctactggacatggtgtatcgtcttgcttggcgcggaaattactgtcactctcggggaataccgcaaactaaaacaagcagctgaacaagaagaagacgacgaaccatgattgcattaattcaacgcgtaacccgtgccagcgtcaccgtggagggagaagtgacgggcgaaattggcgcgggacttttggtgttattgggtgtcgaaaaggatgacgacgaacagaaagcaaaccgtctgtgcgagcgtgtgctcggctaccgcatctttagcgatgccgaaggcaagatgaatctcaacgtgcaacaggcgggcggcagtgtgctggtggtttcccagtttaccctcgccgcagataccgaacgggggatgcgcccaagtttctccaaaggtgcatcaccggatcgcgcagaggcgttatatgactatttcgtcgaacgctgccgtcagcaagagatgaacacgcaaacaggacgcttcgctgcggatatgcaggtatcgctggtcaatgatggccccgtgacattctggttgcaggtatgagccagcttccagggttgtcacgggaaacaagagagagtatcgctatgtatcaccttcgggttccacaaacagaagaagaattagagcgttactatcagtttcgctgggaaatgttgcgtaagcccctgcatcaaccaaaaggttcggaacgcgacgcgtgggatgcgatggcgcatcaccagatggtcgtcgacgagcagggtaatctggtggcggtaggccgactgtatattaatgccgacaatgaagcgtccattcgctttatggccgttcatcccgacgtgcaggacaaagggttaggcacgctgatggcgatgaccctggagtcggtggcgcgtcaggaaggcgttaagcgcgtgacctgtagcgcccgtgaagacgcggtggagtttttcgccaagctggggtttgttaatcagggagaaatcaccacgccaaccaccacgccgattcgccattttttgatgattaagcccgtcgccactctggatgacattctgcatcgcggcgactggtgcgcgcagctgcaacaggcgtggtacgaacatatcccgcttagtgaaaaaatgggcgtgcgcattcagcaatataccgggcaaaaatttatcactaccatgccagaaaccggcaatcagaatccgcaccatacgctgtttgccgggagtttattctcactggcgacgctcactggttggggacttatctggctgatgctgcgtgaacgccacctcggcggaacgattattcttgcggatgcgcatatccgctacagcaagccgattagcggtaaacctcatgcggtagccgacctcggtgccttaagcggcgatctcgaccgtctggcgcgcggacgaaaagcacgggtgcagatgcaggtcgaaatctttggcgacgagacgccgggtgcagtgtttgaaggcacgtatatcgttctgcccgcgaagccatttggcccgtatgaagagggcgggaacgaagaagagtagctgatggagaggggcggtgctgcctctctcattcaggtcatttatattagtccttggctatttcggttatattaaataagaactctataaatttttattcttcgttggctccatacgtgtcttgctacatcactgttcaggagcatttaaatattatttgtagaactgagtggcaattatcgcagataatgcttaattcatcatcttagttcatgtttgagcgatttttgatagtcaaaaccccctctggtgccatacttttctcataaatatttttaaaatctatagctaacaaatattatgcaaagataatggactagcatcattgtcagtatcattcatttactgctctgtatgttatgaataattatgttgtatgtttgctcttaaaccgtgggaaggaggctataatggttgccaatattaatctcattaaacaagaaagttattctgttgttaatttagaaaaacaactttcccgaactgttaccaacaaaattataacgatgagcaagtaaagaccggttggtggcagtactgaccggtctgtgatgaaagattaatttcaccttaaatcctggtgctgttaggatgctgacgtttttcggctacaccattcagattatgcaaataaatatctctgaatataatatattcatagcacccataattcatcctgggcgataactaaaccatttttgagtaataaatgaaacaactgcaacactcttattatttctggaaaacgcctcgcaaaaacaaaacaacatgcaaaaatccgctttttttaaatgattttccggcgtaattttcgcacatacattaatgagtaatatatgtaaggtattggtaatggcgatgaatacggtttttcttcatttatcagaagaggcaattaaacggctgaacaagcttcggggctggcgtaaggtttcacgatctgcaattttacgcgaagcggtagagcaatatctggaacgtcagcaattcccggtgcgtaaagcaaagggaggcaggcaaaagggggaggtagttggtgttgatgatcagtgtaaggagcataaggaatgacaaaaatttttcattcttgaatataaaaaacagatgcccttattctggtattaatacaaggctgttttacttgaacttataataactgcaactgttacatcatatctggaaaacgcctcgcaaaaataaaaaatgatgcgtaaatgagctttctttaaagattcggcaagggtacttttctctccatagattcaaaaatgatattggcgagatatttatgaactctctggcaggtatagatatgggcagaattttactcgatttatcgaatgaggtgattaagcaacttgatgatctcgaggtgcagcgtaatcttcctcgtgcggacctattaagggaagcggtagatcaatacctgataaatcaatcgcaaacagcaagaaccagtgttcctggcatctggcaagggtgtgaggaagatggtgtcgaatatcagcgtaagctgcgcgaggaatggtaatgggaaaaaatgatgtcaatcagattgctgacaacgtgcgcgttgttcatgccggatgcggcgtgaacgccttatccggcctacaaagtcgtataaattcaatgtattgcagtttattggtaggcctgataagcgcagcgcatcaggcaatcttacgcttgtcatcagtctcatgcccataaccttattgatgtggtggtgggtaaattgaggccaaaccggcactggcggcatagcttgaggtggtaacgcggaatacgagagatggtgtcgtcacaccctatgagctgtaatccgggcgacctgcgccacccggaaaacgtcagagattactctccttcacccggaaacaggaacgggttgatggaactgcgggcatagccttcttgctccattcgtgcgtccagtaccagagaggcgaggtcatctgctacggcttcgatttttggatctttttcctgatagagaattttcaggtaagtgtcgcagtcatcgcagctttcggctttaatcgcggcctgttcgtcatccagcgaccagtaatgcagtttgccgctctgctcgcagttgctgcattttacgcgcactacgtgccattcagtttcacacaggttgcagtgcaggtaacgtagcccctgagtggtgccaatttgcaccatgctggacaccggcatagaaccacaaaccgggcaatattgacgttgctcgccgtattcagcgcgggctttgccggggatcagattggccatctgcgcccagtagagcgacagtgcagcccagataaacggcgctttatcgctgctgacggacgagaaatcagaggcaaacagcgcgctggccatatcttccagctcctgagtcgatgccttctccagattctcaatcactgccagcgccgggccgctcatttcaggtttcagctcagcaatcagcgccatcagcagcttttgccagtgcttatcacgcggcagaacgtgaatatccagcgggggcttgccttgtgcgctggcttctttaatgcgcgcagtcagatccatctccagcggatggtcgtacagcaccacttcctgggcgtgggcgataagcgcagcaaagcgcaggtaatcacccagaggattattttctgccagctcgcgcagacgctcggcgcggcggttgtataaattcttgagccgagggaacaataacggcggaatcatatccgccgtacgtttctcgcttgaacccagctcatcttgcgggattatgcgaatactcattcagctttcttttccgttgtcttgcggacctcacggtaccagcgcgggtgatgtttcttcgcccaggcgctggtaacccatccttccaccatggcggtaatcgtgcctttcacccaaagggcggcgtagatatgcaccatgataaccacaattaacgccactgcggcaaatgaatgcagcattaacgcgaatcggatcaccgggattgagaaagcaggcgcaaaataaggacgccagataatcacgccgctcaccagcagcagaaccaggaaaataatcgccgcccagaaaacgcatttctgaccgaagttataacgcccggtgtcacctacttcctcgttgacgacgatcttacgaatattcttcgcccaaaagatatcatcccgattgattaggttgtgatgccagtaacggaaaaacatgatgatgaacgaggcaaacataaccacgccgacaaacgggtgcagaattcgcgccagctgcggtgtgcccatgatttgcatcaaccagttgaaggacgggaacaaaaagcccagcccgctcaccgccgccaggatgaagcagaaggcggtgatccagtggttgatacgttccggcgcggtgtagcgcacgatggtgtcacgtcgtttcatttgcgctcctcgtctttctcttcgtgcagattattctcttcctcatccgcacggttcggaccgacacccacgtagtggaagatactggccgcaaaggtagccgcaaagccaacagccgcgagcggtttccagatgcctttccagaatttcacggtttcgctgatttccgggttctccggcaagccatgatacagatttggcttgtcagcatggtgcagcacgtacatgacgtgtgtaccaccgacgcctgccggatcgtacagacccgcattgtcgtaaccgcgggttttcagctcagcaacgcgctcgctcgccagcgttttcatcgactctttcgtaccgaagtgaatcgcgcccgttgggcaggtcttcacgcaggctggttcttgcccaaccaccacgcggtcaacgcacagcgtacatttgtagacgcggttgtcttccgggttgaggcgcggaatgtcgaacggacagcccgcaatgcaataaccgcagccaatgcactgctcggactggaagtcgacgataccgttggcatactgaataattgcaccttccgccgggcacgctttcaggcagcctggatcggaacagtgcatacagccgtctttgcggatcagccattccagtttgtcgttctgctccacttccgagaagcgcattaccgtccacgatttggcgcttaaatcattggggttgtcgtacaccccaatgttattgccgacggtatcgcgaatgtcgttccactctgaacacgccacctgacaggctttacagccgatacaggtggtaacgtcgatgagtttcgccacttcttcctggaagtcccgcgcctgaggcgcgggggtcagaccgttagtcgcggaacgacgaatgatatcttgagattgataagccatatgtcgtctccgttacaccttttccacattcacaaggaaggacttaaactccggcgtctgcgtgttcgcatcaccaacgaatggcgttaaagtattggcaataaagccttttttagctacgccttcatagccccagtgaatcggaataccgatggtatcgatatctttgccgttcgctttcagcgtgcgaatacgtttggtcaccaccgctttggctttgatatagccacggttggaggagactttcacggtatcgccctgggcaatgccaagtttattcgccagcgactccccgatttccacaaactgctctggctgcaaaatcgcgttcaacagcgcgtgtttggtccagtagtggaagtgctcggtcagacgataggtggttccgacatacgggaacttatcggctttacccaatgcttcggcgtcgtctttaaagatacgtgcagccgggttcgagataacgtttggatgcagcgggttagttcccagcggcgtttcaaacggctcgtagtgttccgggaacggaccttccgccatcttatcgagggcaaacagacgccccatgccttcctgctgcatgataaacggcccgacgccgctacccggaggcgctgcgctgtagtccggaatatcccagccggtccacttagtgccgtcccatttcagcaactgacgcttcggatcccacgggttaccctgcggatctgcggaggcgcggttatacagaatgcggcggttaagcggccatgcccatgcccagcccagcgtgttaccgaggccagacggatcggcgttatcacggcgtgccatctggttgccttccggcgtccagctaccggcgaaaatccagcagccacaggaggttgtaccgtcatcgcgcaattgggcgaacgaactaagttgttggcctttcttgacgataaccgcaccggttgccggatcggtaatatcggccagcgccttaccgttgctctccatcgccacttcttctgaagatggctcatgcggaatggcgtagttccatgtcatgttcagcacctggtccgggttcgcgccaccctgttcggcatacatcttgcgcaagcgcaggaagataccggagaggatctcgccgtcagtcagcgcaatccccggggcgtccgcacctttccagtgccactgtaaccagcgacctgagttaacgatagaaccgttctcttccgcgaagcaggtcgatggcagacggaacacttcggtctggatcttcgacgagtcaacttcgttcagctcaccgtggttctgccagaagttagaggtttcagtgttcagtgggtcgatggtgacgaggaacttcagtttcgacagacaaccgatcactttgtttttgttcgggaatgaggcaacagggttaaagccctggcagatatagccattgaccttgccctctttcatcatctcgaagtattgcaggacgtcgtagcctttatcccacttcggcaaccagtcaaagccccagctattttccgccgtcgctttatcaccaaagaaggccttcatcatagagacgaagaatttcgggtagttgccccagtagtttacctggccttccagcagcggttttggcgtgttggcggtaaggtaggtttgcagatcggtctgcttctcgcttggcagcgtcatgtaacctggcaggctctgcgacagcagccccaggtccgtcagcccctgaatattggagtgaccgcgcagggcgttaacgccgccgcctgccatccccatattgccgagcagcagctggatcatcgccatcgtacgaatgttttgcgcaccaacggagtgttgcgtccagccgagggcatacaggaacgaggcagttttatcgtgagcactggtttctgcgatgtattcgcagactttcaggaacgcgtcttttggcgtaccacagatgttttcaaccacatctggcgtgtagcgggaaacgtgctgtttcagcaagttccacacgcagcgcggatgttgcagcgtggtatcgcgtttggcgaagccgttttcgtccagttcataagtccaggaggatttatcgtacttgcgtttttccgcgtcgtagccggtgaacaggccatcttcaaagccgtaatcctcacgcacgatcaggctggcgttggtataggcttcggtgtattcgcggttgaatttttcattgttcagcaggtacagcaatacgcctgacaggaaagcaatgtcagtaccggaacgaataggggcatagtagtcagctaccgccgccgtacgcgtaaagcgaggatcgatcacaatcagcttcgcgccgttgtgaattttggcttccatcgcccagcggaacccgaccgggtgagcttcagcggcgttaccgcccatcaccacgacgaggttggcgttcttgatgtcgacccagtggttggtcatcgcaccgcgaccaaatgttggagcaagacttgctaccgttggtccgtgtcagacacgcgcctggttgtcgaccgcgagcatacccagcgcgcgggagaatttttgcgttaaatagccggtttcgttactcgacgcggaagcacacagcatcccggtggagagccagcggttaacagtcacgccttcggcgttttgcgcaatgtagttagcatcgcggtcttctttcatcagtttggcgatgcgatcaaacgcctcttcccaactgatttgctgccatttatcagaacctggcgcacggtattccggaaacttcagacggctttcggagtggatgaaatccaccaggccagcgcctttcggacaaagtgcaccgcggttgaccgggtgatccggatcgccttcgatatggaagatagatgctttggcgttttttgctccgtcaccgaggctgtacatcaacagcccacagcctacggaacaataggtgcaggtattacgggtttcgcgggtgcgcagcagtttatactgccgggtttccgcgagtgctacgctgggtgcaaaacccagtgccgctgccgtggtgcctgccataccgccagcgcagatcttaaagaactgccttctgctgacctgcatggattgctccttgtttcgacattgtcacgtcccatttacattcgcttgctgcgtgtgcagggagtgggagttatttttctttgcggaaggggccgcaaaggtccagaattggctcaatttccctccatccaggaagggtttgtaacagaataccataatgttggtgtgtgtgttcttatctggttaagagaaagtgaaaaaaacacagcgaaaagaaatcgaaaatgtgacaaatatcacaggtgttcgtcaaattgagttatggcggcgtgatgatttacaacacccacggttagatgaggtcgcggaagaagttcccgttgcgctggtctacaacggcatttcgcatgtggtgatgatggcgtcgcccaaagaccttgagtactttgcgctcggtttttcgctttccgaggggattatcgaaagtccgcgcgatatcttcggcatggatgtcgttccttcctgtaatggtcttgaagtacaaattgagctttccagccgccgctttatggggttgaaggagcgccgccgggcgctggcgggacgtacgggctgtggcgtatgcggcgtggagcaacttaatgacatcggaaaaccggtgcagccgctaccgttcacccagacgtttgatctcaacaaactggatgatgcattacgtcatctcaacgattttcagccagtggggcaactgactggttgtactcacgccgctgcctggatgttgccatctggcgaactggtcggcgggcatgaagacgtgggtcgccatgtggcgctggacaaactgttaggccgccggtcacaagaaggggaaagctggcagcaaggtgcggtactggtttccagtcgtgccagttatgaaatggtgcaaaagtcggcgatgtgcggcgtagagattttgtttgcggtgtctgccgcgaccacgcttgctgtagaagtggctgagcgctgtaatctgacactggtaggtttttgtaaaccgggtcgggcaacggtttatacccatccgcagcgtttgagcaattaattaaaataagtcctgcgaaatatattaaattgcaggacttattcatttcgtgaattttattattttatttataaacaaaatgcgtgtagtggcgttttcttttttcatttattatgttcactctcttatctatatatttataaggcaattaaatgaaaaggaatttattatcttccgctattatagtcgccatcatgtccctcggtctgacgggttgtgatgataaaaaagccgaaacagaaacgctcccgcctgccaatagtcaacctgccgcaccagctcctgaagcgaaacctactgaagctcccgttgcaaaagcagaagctaaacctgaaacacctgcgcaaccggtggtcgatgaacaagcggttttcgacgaaaaaatggatgtctatatcaagtgctacaacaagttacagatcccggtacagcgcagtctggcgcgttatgctgactggctgaaagattttaaacaggggcctaccggtgaagagcgtactgtttatggcatctacggcattagtgaatccaacctcgctgagtgtgaaaaaggcgtaaaaagtgctgtggcgttaacgcctgcgctgcaaccaattgatggcgtggcggtgagttatatcgatgctgccgtggcgttgggtaataccattaacgaaatggataaatattacacccaggaaaattataaagacgatgcgtttgcgaaagggaaaacgctgcaccagacattcttaaaaaatctggaagcctttgaacctgtagccgaatcttatcatgcggcgattcaggaaattaatgataagcgtcagcttgcggaactgaaaaatattgaagaaagagaagggaaaacattccactactactctctggcagtcatgatttcagcgaaacaaattaataacctgatatcgcaagataagtttgatgcagaagcggcaatgaagaaagtgtctgaactggaaacgctagtggcgcaggccaaagaagcggataaaggcggcatgaatttctcgtttattaattcggcaggccagtatcaactcgaggctaaaaaatacgttcgccgcatcagagataaagtcccgtactctgactgggataaagagcaacttcaggacgcaaactcaagctggatggtcgaagactctttcccgagagcattacgcgagtacaacgaaatggttgatgactataatagcctgcgttaaacgtttttgatgataaatgcagtgtcggatgcggcgcatccgacacagttcaccccttgtgaagtaactccataaatgcctcatatcctgttaacccggcaataatctccgccggatgctgacacaatatgcttgccagatagctaaatatttttagctcatgacgcgcatcggcggcggcgcaggcgatcaagacatggttaatgacttcgttattcacctcaactggttgggcgagggtaataaaaaatccacgaaaacgtcgctcctgttcgctccagcaatgtgggatggcgaggcgattaacaatcaggttttcaccttcgccttcgcgggcgatgatgcgttgtgcttcatcggcggtaatatggtgttgtgcgactaattgcgcacaaatttgccgggtaatatgttgccagctttcaccgcgtacattcgaataatgaaaacttccgggggcagagaaaaaacgctccggctgttggcgaataaatgccgtcgccagaaaatgttttatttgttcgataccggcagccgtaatgatattttttacggtgatgtaattatttaccgcgtcatccagtaaataatggctgttgttaatgatcaataacggctcaatctcttcgcgaatggcaacaagttcgcttaagctacgggcaataattacccgacaatttaaaacatcgcgctcaatggcgagctgattaatagtggcaatcgcgttctggtccgagagcaaaatgatcggctggcgttcgttttgatgccgctccagcgcacaggcaaaatacaaaccgatcagatcgctgtcgaaaaggggaatatcgagctgttcacgcagtagcgtaataaagtgcagactcatatcaaaggccgcaggccaggcggctttcaggttattcatgctgctctggcggtgctcagcaatccacactggtgcggcaaggcaacgtaataaatgcccggtaatattctcaaccagctgcgcatcaataatattcaatgacgcgatgcccggcaccctttgcagcaacccctgcacattatcggctgaaattacctgcgcttgctgatgctgtttctctatcaaacccgtcagggttcttacagcgttatcaccaagaaacagaccgctatgttcaacgatttgttttatctcgtcaccgggatattgcggccactcatcggtcagttgattacgcagggcgtaaatcgccagaatcaggctggagagataatcaccctgcatgagcggccagcggtgttggttgtcgcaggccgtggataaatgctgaaggttgtctcgtgttatgcccgccagcggaattaaaaacggatctttgcgcagcaagttcgccagcaagataacgcgtttctcttctgtctcatcaatgaaatggcccaaaccagggcggctggccaggcaacaagtgcgttcataacgctgttttaaccggggcagacgctctgctacccacgtttctggcaaattaagcgccgaggcgagttgcgcacggggagtgaaagtattcagtaataacagcgccagcagccgatcgtcgttatcgtgcttttgcagcaactgaaaaaagctgcggcgctcgaagatttccagctgatagcccgcactgccactggcgaaaatgcgggctttgccgttaagggtgaagttgagatagtcaatatcacgcaggatggtcctgcctgaaacgccagtctgttgcgccagctcgccaggcgtgcgcggctgttgctccagcagatcgacaatctttaactggcgttcgtttagcattaatccacctgacggaactggctaaacgcgttgactttctccgcagttaaggtcgtcagaaaaccccgtatcagcgtgagcagagcttcgtaatcggcttttgaaatcataccgctgttggcgtgcagataacgagttggcagacacagcgcgacaaccggacgcccgccgcccatcacgttgtagcgcccgccatccgtcgcaccggttttcatggtggaaaattgcagcggtaaatcgttatgtgcggcacagctttttaacgctgctaccagtttctggttggggaagtagcgcttgtcaaacagcatcagccccggcccctggcccagtttcagcgggtatttaatgttatcaatgcccggaacatcgcccgctacggcggtatccaacacgatcacgacgtccggtttaatgtgttccgccgaggtttgcgccccgcgtagcccaacttcttcttccacactgccaacgccatacagcgtaatttcgggattattcaccgtctgcaatagttcagccatcattgcgcagccgatgcggttatccaacgccttgccgaccactttatcttcgccccagcaggcaaaattggcttccgggctaataaaattaccaatttccacgccgcgcttttccacctcttcgcgactgttcgcgccaatatcaatgaacatctcatcaaatgacagcggttgttgcttttgcttttccgttaacgcatgaggcgcgacggaaccaatcacaccagggattttcactcccttgtgtgtgcgtatggttacccggtggttgagcatcgactgattccaccagccgccaatggtggtaaaacgcagaaaaccgctctcgtcgatgtgggtgaccataaagccgacttcatccatatgtccgacaacggcaacttttggacctttattccccttacgggcaacaaagctgcccagaccatcgaaggtgatttcattcacgcaaggttccagcgtgtttatcagaatgtcgcgaacttcctgttcatcgccgctgacggcgctggcttcgcacaactgttgcagtaactcaatgttcatggacaagctcctgttgcgcggctttcgctttgcggcgtaaccacaatcctttcaggacgataatgaatgaaatgttcagcgcgaggccaatcgccagcaccagataaaacgaacccaccggcgacatcaggccgatcagcgggtcaaagatacccaaaccaggtgccagacgtttgattccgaaagcgatcaccagcacgccggtaatgccgcccgccagcgtattggcggtaatcatcggcaacggagctgccagagcgtaaggaatagccggttcggttgcgactgtggcaccgaccacaatggcactactggcagcctctttttcctgtcgggtaaacagtttgggcgcaatgaacgtcgcaagacccgccgcgacgggcggcatcagcgcgacaacgccgacgatggcgtaccagtcataaatgtgtttttccagcagtgagaagcagaagaaccaggcggttttattgatggggccgcccatatcgaacgccagcatcgcaccgaccagaaacgctgccgcaaacttcattgatggaggaatggtattcaggaagtggagcagcccgcccatgaggtcggacatcaccggcccgataacgtagtaagtgagcacgccgaaaaccagcagagtaacgaacgggatcagcattgaaccgagcagcggttgtaatgctttgccaaggcgcactttgcggaaccagaagacgaaatagccaatcgccagccccagcaccaccgcgccgaggaatcccgcacccgactgggtgccgagcagcgctttgtcgttcgccagatagcaaaccagaaacgccggagcgaaagccggtttatcggcaatcgacgaggcaatataagcgcccatgatggggatcataaaggtgaagccaaggtaaccgatggattcaactacccaggtaaacgacggcgcgcctttcgacatatcggtatacggcaaaccgaactgcaccagcatgttggcaagcgccaccaggataccaccgccgatgacaaacggcagcgccgcagagacgcccgccatcaggtggctcatcacgctaccgctttgcacttcctgtttgccaagcttcacgccgctatctgcggcaaaaagctgcgagtttgtcggtaattcgctgaaaatctggtcgatatttttcaacgcctgggagatggcaatctcataaactttcttcccggcaaaccgcgcgcgatcatcaccgctcaggccacgcccggtagcgagaatgacgtaatcggcagcggcaatctcttcgctggataagcggttttcaacgccactggacccttgagtttccacttttatggtatgaccgagagaacgggctttctgttccagggcttccgccaccatgtaggtgtgagcgatcccggcggggcagttggtgatcgcgacaatacgtaaggatgactccatcgccacttccttatgagctgagggtttgatttaacaaggcaagcacctggtcggtatcgccctgttgcagttgatgaataaattccttgtgaataattttgcgacacagtgtgccgatgattttgacctgatcctcttcgccgctttgcggcacgccgaggcagatccagcaattgacgtcttcgccatcgctggctttccagtcaatagcctgcgctttgcgggcgaataatacgaacggttgtttaacgcaggcgcttttaccgtgcggcacggcgacaccggaaccaaatccagtagagtgcattttttcgcgcagcagcagggtttgcaggaactggtgtgagtcggtgataaaaccgttttgtaacgctattgtcgccaactgcttcagaacggaataagcgccattgccctgaatattcaggtcaatacagcttgcagtaagagctgccattaatcggactccataaaatatattttaatcaattgtaatggtggagcgattaagtgatgagaggcgatatgtcggtaaacaatgacaatttgagacagagtgaaaggtcagatttgcggagtaatgcacataatggttatttaaataaaccacatgaatcattaatgggttattcattatttttgtgatttactcacaatgtatcagggaaatataacttaccgggagatgtaatatgtttaatttttcaaatcgaaatttaaaatattgtgccggaggcatctctggcacattgggcaattacggcaggtaaaacacttcttgcagctcgctactcaccgggctgttatccgggttagcgggcataacatcggtcatatatttccaccaacgttggcaaacatcagtgctggcaaccgcattccagcgttcttcagattcaatctctaccatggcaaacagcagattacgcgctttgtcgagatagatggcgtagttatgcgcaccgtgagatttcagcactgcttccagttctggccagatgggattatgccgacgctgatactcttcgtgggcgtcggggtttacctgcatgacaaaggctttgcggatcatgtttgctccttacagcgccagcgcactggcgagtggcgtaacgccgaaacgcttgccgagcgctatcaactcttcacggctgatggtctgtttcatgccgcccatcgaataaaccttcactaatacttgtgctgatttttctgcggtgtcgattaaaccgaaggtttcatccagcgtcggtccgctgccgaagacgccgtggaagggccacaacaccagcgaatgtttttgcatctcttgtgcggtcgcctggccgatttcgtccgtgccgggcaccatccacggcaaaatgccaacgccatccgggaataccaccagacactcggtgctgccttcccacagttggcgagtgaagaccgcggtgtcgttttcaagtacataggtgagggcgatcaggttggtggcgtggcagtgcatgatcacccgatctttgccgttggtggctttaatgcgctcgcagtgggaaaggaagtgagccggaagttcggaagtggggacggcttcgttggttaacccccaaagaatgtggtagcccgcgccgtcgctgtcgacttttacgatgcctaagttagccgcaggatcaagctggacgttacggaagaatttgcccgagccggtgacaataaacggtgtatttgccagtaaaggcatgggctggctgagcgggatatagcgcggttgttggtggaaattgtcgtgatatggtgcgatatcggcgtcatccaggcgtagcgtcaggttgccgccgttgcgctcatcccagcctttcagccaggcgtcggtggtggctttgatcattccctggacaaaccaggactgagtaatgttttgcatgttctgtgttcctgtaaattcggtgttgtcggatgcacgacccgtaggccggataaggcgctcgcgccgcatccggcaatcaatgcctgatgcgacgctgtcgcgtcttatcaggcctacaactattgccgacctgtaggcctgataaggcacttgtgccgcatccggcaatcaatgcctgatgcgacgctgtcgcgtcttatcaggcctacaactgttgccgacctgtaggccggataaggcacttgtgccgcatccggcaatcaatgcctgatgcgacgctgtcgcgtcttatcaggcctacaactattgccgacctgtaggccggataaggcacttgtgccgcatccggcaatcaatgcctgatgcgacgctgtcgcgtcttatcaggcctacaactgttgccgacccgtaggccggataaggcgctcgcgccgcatccggcagtgtttacccgcggcgactcaaaatttctttctcataagcccgcacgctctccagccattcgctacctgctggcgtatcgtgacgttggcaatacatttcccagaccgcctgccacggcaacgatttctgctcttccagcagtgccagacgcgcagtgtaatcgcccgccgcttccagcttgcgcagctcagcggtaggttccagcaacgcacgcagcagggcttttttcatattgcgtgtaccaatgacccacgcggcaatgcggttgatagaggcatcgaagaagtcaaggccgatatgcacccggtcaaacagatcgtgacgcacaatctcactggcaattgcctgggtttcatcatccagcagcactacgtgatcgctgtcccagcgaaccggacggctgacgtgcagcagcaactgcggcacatacagcatggcggcggaaatcttgtcggaaatcacttcagtcgggtggaagtgcccggcgtccaggcacagcgcagtctggcggctggtggcataccccatgtaaaactcattggagccaaccgtgtagctctctgcgccaatgccaaacaatttgctctcaacggcgtcgatatggtgcgcagggtttagcttctcgctgatcacctcatccagtgctgccagcagacgctgacgcggggcgagacggtcaacggtgatatctttcataccatccgggatccagatgttcatcaccgatggtgtgccgagttgctcgccaaaataggccgaaacgcgacggctggctttgcagtgatcaatccagaactggcgaatgctgtcgtcggcatgggaaagcgtaaagccatcggcgcttagcggatgcgaaaagcaggaggggttaaaatccagaccgagctgattggctttcgcccattcaacccagtttttgaagtgctctggtttgatctggtcgcgcgagactggcgtatctgattccagatagatggcatgtaaattaagccgtttcggccccggaatcagccgcatagcctgttccagatcggcacgtagctcactggcattacgcgctttgcccggataattgcctgtggcctgaatccccccggtcagcgaaccttccgggttttcaaaaccggaaacatcatcgccctgccagcagtgcattgaaacgggtaaacgatcaagttggcgcagcgcctcctcgacatcaatccccaccgccgcgaaacgctgtttcgctagctcccaggcctgttccagttgagtggtcatgcgcaaagctcctttgtctgtcgtgtagagtgaatctgcgccacatagtgggcaatttcactgtcaggattaggggtaaaggtggtcagattcgcggtggtgctgacgacctgacggaaatcatccacattgttgagttcatccagcgtcattaactggatgccgatattgccgagcgtcgaggcttcaacaggcccggcgatcacccgaataccgcaggcatcggcgcatagctggttgagcagcgtgttctggcagcctccgccgacaatatgcagttgcgagaaatcttcaccgcgcagctgcgccagctcatgcaacacatcggcatacagcagcgccagactgtcgaaaatgcagcgcgccagttcagcatcactttccgggatcggttgcgccgtttcccgacacgcagcctgaatttcgctgcacatcgtctcaggattaataaagcgatcgtcattgggattgataatgaagcggcaagccggaagtgcctgtgtcgcggagataagcgccggaagatcgttgatttgctgctcctgaagcactcgctgaagcagccataagcccataatatttttcagcacccgatagcgaccttccgccccgccttcattggtgatgttggctgccagtgccgtgtcattggtaaatggcgtctggctttcgaagcccatcaatgaccaggtgccagaagagagataagcagcacgtgagccgtttaacggcgaggcgataaccgcgctggcggtatcatggctggcaacggcgaccactggaatctcattaccctgcgggcaaatccagtgacctatgacattacccggatgcgtcgggcgaccaaaccaggctttgttggccccgctccacgccagtagcgactcgtcccagtcgtcgctattgatattgaccagttgcgtggtcgtggcgttggtatattcccagttcatcttgccggtcaggcgataactgaagtaatccggcatcagcagagcgtgagcaatgtgtggaataagttcaggttgttgctccgtcagcgcacgcaactgataaagcgtattgaagggcagaaactggatgccgctacgttgataaatatcgcgtttgccgagttgttgttgtgcctgcgccattaggccattggtgcggctatcgcgataagcaacgggcaggcccacacgctgaccctgttggtcgagcagcacaaagtccacgccccaggtatcaatcccaatgctatcgatacgaatcccttcctcgcacaccttgtttaatccaaggcgaatggcactttcaaggctatccacatcccaggtgacatagccgttctgactatgcagcccattgttaaaacgatggatttcgcgcagcgtcaggctgcggcattcacgctcgtaacgcgccagcatcacgcgcccactggatgcgccgagatcgacggcgacacaattgcgaaaggtcataatgtgatcctgctgaatttcattacgaccagtctaaaaagcgcctgaattcgcgaccttctcgttactgacaggaaaatgggccattggcaaccagggaaagatgaacgtgatgatgttcacaatttgctgaattgtggtgatgtgatgctcaccgcatttcctgaaaattcacgctgtatcttgaaaaatcgacgttttttacgtggttttccgtcgaaaatttaaggtaagaacctgacctcgtgattactatttcgccgtgttgacgacatcaggaggccagtatgaccgtattacatagtgtggatttttttccgtctggtaacgcgtccgtggcgatagaaccccggctcccgcaggcggattttcctgaacatcatcatgattttcatgaaattgtgattgtcgaacatggcacgggtattcatgtgtttaatgggcagccctataccatcaccggtggcacggtctgtttcgtacgcgatcatgatcggcatctgtatgaacataccgataatctgtgtctgaccaatgtgctgtatcgctcgccggatcgatttcagtttctcgccgggctgaatcagttgctgccacaagagctggatgggcagtatccgtctcactggcgcgttaaccacagcgtattgcagcaggtgcgacagctggttgcacagatggaacagcaggaaggggaaaatgatttaccctcgaccgccagtcgcgagatcttgtttatgcaattactgctcttgctgcgtaaaagcagtttgcaggagaacctggaaaacagcgcatcacgtctcaacttgcttctggcctggctggaggaccattttgccgatgaggtgaattgggatgccgtggcggatcaattttctctttcactgcgtacgctacatcggcagcttaagcagcaaacgggactgacgcctcagcgatacctgaaccgcctgcgactgatgaaagcccgacatctgctacgccacagcgaggccagcgttactgacatcgcctatcgctgtggattcagcgacagtaaccacttttcgacgctttttcgccgagagtttaactggtcaccgcgtgatattcgccagggacgggatggctttctgcaataacgcgaatcttctcaacgtatttgtacgccatattgcgaataatcaacttcgttctctggccgaggtagccacggtggcgcatcagttaaaacttctcaaagatgatttttttgccagcgaccagcaggcagtcgctgtggctgaccgttatccgcaagatgtctttgctgaacatacacatgatttttgtgagctggtgattgtctggcgcggtaatggcctgcatgtactcaacgatcgcccttatcgcattacccgtggcgatctcttttacattcatgctgacgataaacactcctacgcttccgttaacgatctggttttgcagaatattatttattgcccggagcgtctgaagctgaatcttgactggcagggggcgattccgggatttaacgccagcgcagggcaaccacactggcgcttaggtagcatggggatggcgcaggcgcggcaggttatcggtcagcttgagcatgaaagtagtcagcatgtgccgtttgctaacgaaatggctgagttgctgttcgggcagttggtgatgttgctgaatcgccatcgttacaccagtgattcgttgccgccaacatccagcgaaacgttgctggataagctgattacccggctggcggctagcctgaaaagtccctttgcgctggataaattttgtgatgaggcatcgtgcagtgagcgcgttttgcgtcagcaatttcgccagcagactggaatgaccatcaatcaatatctgcgacaggtcagagtgtgtcatgcgcaatatcttctccagcatagccgcctgttaatcagtgatatttcgaccgaatgtggctttgaagatagtaactatttttcggtggtgtttacccgggaaaccgggatgacgcccagccagtggcgtcatctcaattcgcagaaagattaattcgccatgccgatgccgacgatgttagcggcgacaataatcaccacacaaccgaggctcaacaccgttaccggacggcgtcctgcattgttccactctttcagcaccagcccgacgataccgccgcacaatacatagaaactcatatgcagcatccaactgatgtagtcatactgcgccggaatgcgggcgtggccccaggcatagaaaaagaattgcagataccacatcaacccgcccagtgtcgagagtaacacattgtgaatgatcagcgattttgccagcgagaagtcggcttttagcgacaaatccttcacttttgccagacgaataaaacagaaaccgaggttaatgatcgcgccgccgcccatgatgacaacatagcttggcagagcgacatacagtggatcgacgccaagtgcggcagcggcttcatgcatcggttttgcggcgttcatcgcaaaggacatcccggcagagaaaatgccgcacatcaccgccagcaccagcccttttttcagattgaactcttcggctttaatgcccatcttgcgctctttcaactgcccggcgcgagttacaatccctacgccaatcagcgccaccagaacgccgagcaacgtcatgcgtccgccttcggtgctaatcaacacatcgaaattgccgttgataattggcgtcatcagcgtaccgacaatcaacgtaatgccaatggcgatgccaattcccatcgacatgccgagataacgcatggtcaggccgtagttgatattaccgatcccccacatagcgccgaacagaaaaacaggcagtcgcgtagagagactaaacgagctgtaatacgcccagaaattcggtagtaacagggcgctgatggcccacggcagaataatccacgaaacaatcccaccgactgaccacatggtttcccatgaccatttttttacttttttgaacggagcgtaaaaacaggctgcactggccgcgccgatcaaatgccaaaatatccccatcgtaatcgcgttactcatcttcttatcctcatcatttttcgtcgcgtcacatctccgacgagatgagtgtaaaaatcgtgctgtcgattaacctttcgcctgttgccgccgttgtcgatttactggcaatcacggcattaagtgggtgatttgcttcacatctcgggcattttcctgcaaaaccatacccttacgaaaagtacggcattgataatcattttcaatatcatttaattaactataatgaaccaactgcttacgcggcattaacaatcggccgcccgacaatactggagatgaatatgagctataccctgccatccctgccgtatgcttacgatgccctggaaccgcacttcgataagcagaccatggaaatccaccacaccaaacaccatcagacctacgtaaacaacgccaacgcggcgctggaaagcctgccagaatttgccaacctgccggttgaagagctgatcaccaaactggaccagctgccagcagacaagaaaaccgtactgcgcaacaacgctggcggtcacgctaaccacagcctgttctggaaaggtctgaaaaaaggcaccaccctgcagggtgacctgaaagcggctatcgaacgtgacttcggctccgttgataacttcaaagcagaatttgaaaaagcggcagcttcccgctttggttccggctgggcatggctggtgctgaaaggcgataaactggcggtggtttctactgctaaccaggattctccgctgatgggtgaagctatttctggcgcttccggcttcccgattatgggcctggatgtgtgggaacatgcttactacctgaaattccagaaccgccgtccggactacattaaagagttctggaacgtggtgaactgggacgaagcagcggcacgttttgcggcgaaaaaataatcatttgccgcctgctgcaatgaggcgtataggccgcatatcagcttaaaaaatgaaccatcgccaacggcggtggtttttttgtgatcaatttcaaaataaaaacaatgatccgataaaaataaaacagcgtttcaattgatgtggttttgatcacttttattgattaaatgaatgtctatcttcgtttccatcaacactgatgctccattgaggaattacgcatcagcccttaaaaatatgccgacaggtgatggaaatgcagataaaacgctcgattgagaaaatcccgggggggatgatgctcgtcccgctattccttggcgcactgtgccacaccttctcgccgggggcggggaaatattttggatcattcaccaacgggatgattaccggtacggtgcccattctggcggtgtggtttttttgcatgggggcgtcaataaaattaagcgcgacgggaacggtactgcgtaaatccggtacgctggtggtaactaaaattgccgtcgcgtgggtggttgcggcaattgcctcgcgtattattccggaacatggtgttgaagttggattctttgccggactttcaacgctggcgctggtggcggcgatggatatgaccaatggcggactttacgcttccatcatgcagcagtacggcacaaaagaagaagctggggcatttgtgttgatgtcgttggagtccgggccgctcatgacgatgattattctgggcactgccgggattgcctcgtttgaaccgcatgttttcgtcggcgcagtattaccgttcctggtgggctttgccctggggaaccttgaccctgaattgcgagaatttttcagcaaagcggtgcaaacgctgattccattctttgccttcgcgctgggcaataccattgatttgactgtgattgcccagactggtttgctggggatcctgttgggtgtggcagtaattatcgtgaccggtattccgttgattatcgccgataaattgattggcggtggcgatggcactgccggaattgccgcttccagttccgcaggggccgcggtagcgacacctgtgctgattgcagaaatggtgcctgcgtttaaaccgatggctccggcagcaacttcgctggtagcgacggcggtcattgtgacttcgattctggtgccaattcttacctctatctggtcacgtaaagtcaaagccagagcagcgaaaatcgaaattttaggtacggtgaaataaacctgcttccttaatccccacagccggatgaactaacgttcgtccggtttgctattgagttcctgcctggatacttaccgcgaaaacagcacgcctgacataaaataaatatggtctaatggggaaatttctcgtggagagggaacagatgcgatatccggttgatgtatacacaggcaagattcaggcttatcccgaaggcaaacccagcgcaattgctaaaatccaggttgatggtgagttgatgctgacggagctggggctggaaggtgacgagcaggcggagaaaaaggttcacggcgggccagacagagcgctgtgtcattatcctcgtgagcattatctctactgggcgcgggaatttccggaacaggcggagttgtttgttgcgcctgcgtttggtgaaaacctctcaaccgacggcctgacggaaagtaatgtttatatgggcgatattttccgctggggagaggcattaattcaggtcagccagccgcgctcgccttgctataaactcaattaccattttgatatcagcgatatagcgcagttgatgcaaaacacaggtaaggtggggtggttgtatagcgtgatagcgccagggaaagtgtctgcggacgcgccgctggagttggtttcccgtgtcagcgatgtgaccgtgcaggaggctgccgccatcgcatggcatatgccgtttgatgacgatcaatatcaccgtttactctccgctgccgggttatcgaaaagctggacgcggacgatgcaaaagcgccgactgagcggcaagatcgaagatttttcccgccggttgtggggaaaataacccccggagtgtaggcctgataagacgctatcagcgtcgcatcaggcatcctgctcaaatgccggatgcggcgtaaacgccttatcctgcctgcaaatgcgaagtttaactccgcttatacagcggcaaccaaatcaccagccgtaaaccgcccagcgggctgtcttctgccttcacccagccacgatgctgctgaatggcggtttcaacaatcgccagccccaaacctgtaccgccagattcacgatcgcgtgcttcatcggtacgatagaacggacggaaaatctgttcgcgatcttccgggctaacgccaggaccatcgtcgtccaccgtaatggtgataccgtctttatctaccgcaaagcccacttcaatcttcgtatgggaataacgcagagcattacgaacaatgttttccagcgcactttccagggcgttcggattgccgtacagcggccacggcccaggcgggaagttaactgtcaacgacttgcccatttgctcggcttcgaacgccgcgttatccagcacttcactccacaactggttggctttgatggtttcgctaaccagcgcgtttttttgctgattacgtgacatcaccaacagatcgttgatcatgctgtccagacgttgcgcttcggtttcaatacgctccagttccttgctttcaccgctacgacggcgcagtaacgccgtacccagttgcagacgcgtcagcggggtgcgcagctcgtgagagatatcagaaagcagacgctgctgagaggtcatcatgcgctccagcgcggtgaccatctggttaaaactggcacctgcggcaaggaattcctgtggccccgcttccagttccgggtgctggcgtaagtttccctgggcaacttcatcggcagcgtttttcagcttacgcgccggttttgccagactccaggccaaccacaacagcagcggcgtactgaccaacatggtgacaatcagcagtaatagcgggcggtcaaacagtaagttaatgaaatcggattgagaactgctggccggacgaatcagataaagttggtaattatcttcgccatcacgcacggagaacggaccgaccagttccacgcggccatactttttcttctgcggatgatcggcgttatcggcctgaccaataaagttacgaatgatctgcatttcgctgcgttcagcgccgatcacgcggccttcggtggtcaccaataacaaacgctgtcctggcggtgcccacttatcaatcgcccggaacagacgccgccaccacattaaatcgttgggcggatcgttcgccagctccgcttcgacatgctgctcaatcatcagcccctgacgctgttcgctatccagaagctcggtcatctggcgtgaatcgagcttgggtaacatcaaaaccaacatcaacaccagcgccagcgtcagccagaagatggcgaagatgcgcgcggttaagctgcctatcatgaagcagaaaccatcagatagccgcgaccacgcaaggttttaaaccacgggtgaccatctttacgatccggcagtttacgacgcaggttggaaatgtgcatatcaatagcgcggtcgaaaggcgtcaggcgtttgcccaacacttcctggcttaaatgttcacgggaaaccacctgacccagatgctgtgccagcaaatagagcagggtaaactcagtaccggttaactccagcgtttgcccgtcgaagctggcttcctgacggcctggattcagcactaaggcatcaacttccagtgtcggtgaaccgttgtcgttgttttgctgttgctcgctccagtgcgaacggcgcaggatcgcgcgaatacgtgccaccagctcacgatcattaaacggtttcgggagatagtcatctgcgcccagctcaaggccgagaacgcgatcaagttcactgccgcgcgccgtcaacataatgacaggcgtctggtgtgtctggcgaagtgcttttaatgtgtcgataccatttttcttcggcatcattacgtcaagcaaaagtaaatcaatgctgtcgtccagaagatcaagcgcctgttccccatcgtgggcaacaatcacgttgaagccttccatctcgagcagctcctttaatagggaagtcagctctcggtcatcatcaactaacaggattttattcattgtttaaatacctccgaggcagaaattacgtcatcagacgtcgctaatccatgactttacgttgttttacaccccctgacgcatgtttgcagcctgaatcgtaaactctctatcgttgaatcgcgacagaaagattttgggagcaaatgatgcgcatagttaccgctgccgtcatggcctcaacgctggcagtcagttcattaagccacgctgctgaagtcggttcaggcgataactggcatccgggtgaagaacttacgcagcgcagtacgcagagccatatgttcgacggcataagtttaaccgaacatcagcgtcagcagatgcgagatcttatgcaacaggcccggcacgaacagcctcctgttaatgttagcgaactggagacaatgcatcgccttgtcaccgcagaaaattttgatgaaaacgctgtgcgcgcacaggcagaaaaaatggcgaatgagcaaattgctcgtcaggttgagatggcaaaagtccgcaaccaaatgtatcgcctgttaacgccggagcagcaagcggttttaaacgagaaacatcaacaacgaatggagcagttgcgtgacgtgacgcaatggcaaaaaagttcatcgttgaagctattgagtagtagcaactcacgttcccagtagtaaaccctgttttccttgccatagacaccatccctgtcttcccccacatgctgtgggggttttttttatcctcaatttgcctgctgcttaatgcattgcagatgatttgcttccgttatactagcgtcagttgatagcgggagtatttatgaatcaatcttatggacggctggtcagtcgggcggcgattgctgcgacggcgatggcttcgctgctattgctgattaaaatttttgcatggtggtataccgggtcggtgagtattctcgccgcgctggtggattcgctggtggatatcggcgcgtcgttgacgaatttattggtggtgcgatattccctgcaacctgccgacgataatcactcgtttggtcacggtaaagctgagtccctcgcggcgctggcgcaaagtatgtttatctccggttcggcactattcctgtttttgacgggtattcaacatctgatatctccaacaccgatgacagatccaggcgtcggggttatcgtgacaattgtggcgctaatttgtacgattatccttgtctcgtttcagcgttgggtggtgcggcggacgcaaagccaggcggtgcgggctgatatgctacattaccagtctgatgttatgatgaacggcgcaattctgctggcgctggggttgtcctggtacggctggcatcgcgccgatgctctgtttgcattgggaatcggcatctatattttatatagcgcgttacgcatgggatatgaggcggtacagtcattactggatcgcgcattgcctgatgaggaacggcaagaaattattgatatcgtgacttcctggccgggtgttagcggcgctcacgatcttcgcacgcggcagtcagggccgacccgctttattcagattcatttggaaatggaagactctctgcctttggttcaggcacatatggtggcggatcaggtagagcaggctattttacggcgttttccgggatcggatgtaattatccatcaggacccctgttccgtcgtacccagggagggtaaacggtctatgctttcataatcagtataaaagagagccagacccgcattttgtgtataaaataccgccatttggcctgacctgaatcaattcagcaggaagtgattgttatactatttgcacattcgttggatcacttcgatgtgcaagaagacttccggcaacagatttcattttgcattccaaagttcagaggtagtcatgattaagaaaatcggtgtgttgacaagcggcggtgatgcgccaggcatgaacgccgcaattcgcggggttgttcgttctgcgctgacagaaggtctggaagtaatgggtatttatgacggctatctgggtctgtatgaagaccgtatggtacagctagaccgttacagcgtgtctgacatgatcaaccgtggcggtacgttcctcggttctgcgcgtttcccggaattccgcgacgagaacatccgcgccgtggctatcgaaaacctgaaaaaacgtggtatcgacgcgctggtggttatcggcggtgacggttcctacatgggtgcaatgcgtctgaccgaaatgggcttcccgtgcatcggtctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggagatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggcggtcgttgtgtaggtatccagaacgaacagctggttcaccacgacatcatcgacgctatcgaaaacatgaagcgtccgttcaaaggtgactggctggactgcgcgaaaaaactgtattaatgatttcggaaaaaggcagattcctttaccctgaaaccgatgacagaagcaaaaatgcctgatgcgcttcgcttatcaggcctacatgaattctgcaatttattgaatttgcaaacttttgtaggccggataaggcgttcgcgccgcatccggcatggacaaagcgcactttgtcagcaatatgaggcggatttcttccgcctttttaatccctcaacatatacccgcaagttatagccaatctttttttattctttaatgtttggttaaccttctggcacgctttgctcatcacaacacaacataagagagtcgggcgatgaacaagtggggcgtagggttaacatttttgctggcggcaaccagcgttatggcaaaggatattcagcttcttaacgtttcatatgatccaacgcgcgaattgtacgaacagtacaacaaggcattcagcgcccactggaaacagcaaactggtgataacgtggtgattcgtcagtcacacggtggctcaggtaaacaagcgacgtcggtaatcaacggtattgaagctgatgttgtcacgctggctctggcctatgacgtggacgcaattgcggaacgcgggcggattgataaagagtggatcaaacgtctgccggataactccgcaccgtacacttccaccattgttttcctggtacgtaagggaaatccgaagcagatccatgactggaacgatctgattaaaccgggtgtttcggtgatcacgcctaatccgaaaagctctggtggcgcgcgctggaactacctggcagcctggggctacgcgctgcatcacaacaacaacgatcaggcaaaagcacaggattttgttcgggcactgtataaaaacgtcgaagttctggattctggcgcgcgtggctccactaacacttttgtcgagcgcggaattggcgatgtactgattgcctgggaaaacgaagctctgctggcagcgaatgaactggggaaagataaattcgaaatcgtcacgccgagtgagtctatcctcgcagagccaaccgtgtcggtggtcgataaagtggtcgagaaaaaaggtactaaagaggtggcggaagcctacctgaaatatctctactcgccagaaggtcaggaaattgccgcgaaaaactactaccgtccgcgcgacgctgaggtggcgaaaaagtacgaaaatgcgtttccaaagctgaagttattcaccattgatgaagagttcggcggctggacgaaagcgcaaaaagagcattttgctaacggcggtacgttcgatcagatcagcaaacgctgatttccccaggataattatcaaacccggtggtttctcgcgaccgggttttttatttgtcacgattttgcgttacccttgcatctctttgaggtacagggaaaaaaagatgaaaaaagcgggtcttctttttttggtgatgatagttatcgccgttgtggctgccggtattggttactggaaattaaccggtgaagagtcggatacattacgtaagattgtccttgaggaatgtttgcccaatcagcagcaaaatcaaaatccttcgccatgtgcggaagtcaaacccaatgccggatacgtggttttaaaagatcttaatggcccactgcaatatctgttgatgccaacgtatcgtattaacggtactgaaagtcctttgttgaccgatccttcaacgccgaacttcttttggttggcttggcaggcgcgtgattttatgagcaaaaaatacggccagccggttcccgatcgcgcggtttctttggcgatcaactcccgcaccgggcgtacgcaaaaccattttcatattcatatctcttgtattcgtcctgatgtgcgcaaacagctggataacaatctggcgaacatcagcagccgctggttgccactgccaggtggtttgcgcgggcatgaatacctggcgcgtcgggtaacggaaagcgaactggtacaacgcagcccatttatgatgctggcagaagaagtacctgaggcgcgggaacatatgggacgctacgggctggcgatggtacggcagagtgataactcatttgtattgctggcgacacaacgaaatctactgacgcttaaccgtgcttcagccgaggaaattcaggatcatcagtgtgagattttgcgttaaggcgaagagttaaggaaagtaagtgccggatatgaaatccggcacctgtcagacttaagcctgtttagccgcttctgcagctttaacgattactgcgaaggcgtcagctttcagagaagcaccaccaaccagcgcgccgtcgatatccggctgagcaaacagttctgcagcgttagacgcgtttacagagccgccgtactgaatgatcacttgttcagcgatgttagcgtcaactttagcgatgtggtcacggatgaatttgtgaacagcctgtgcctgagccggagttgcagatttgccagtaccgattgcccatacaggttcgtaagcgataaccgcaccttcgaatgccgcagcaccctgagttttcagtaccgcgtcgatctgacgtgcgcaaacttcttcagttttgcccgcttcattttcagcttcggtttcaccgatgcacagaaccggagtcaggccctgctctttcagcaccgcgaattttttcgcgatcagttcgtcagattctttgtggtaagtacgacgttcagagtgaccgatgatgatgtactgtgcgccgatgtctttcagcatagcagcagaggtttcaccggtgaatgcgccggacaggttcaggtccacgttttgcgcacccagcatgatgtggctgccttcagcttcgcgcttcgccatatcgatatacatttccggtggtgcgattgcaaccgcacagccagcaacacctgccagctctttacgcaggttagaaaccagctcgtgaaccatgtggcggctgccgttcagtttccagttacccatcactaaaggatgtcgcattttaattctccacgcttataagcgaataaaggaagatggccgccccgcagggcagcaggtctgtgaaacagtatagagattcatcggcacaaaggctttgctttttgtcatttattcaaaccttcaagcgattcagatagcgccagcttaatcggttcaacagcgaaggtcagccccttttcgccgttgtccgcgacaacataacgcagtgcaccttctgtctcggtgtaataacgtttgtttttccccgccgttagtagcgactgcagttttttctggctttgtgttttggtcattaatggggtgagtgtgcggatcaccgctgccatgtattcctgagctttcgctttcgcggctttttgctctggcccctggatgggtagccaggtcatttgaatgcttttgatttttaaggtaccgcgctccagcgctgtagaagcatacaagttctcattaattttacttgcagcacgagtgagattggctttgtcgggactgctgtcgatggcacgaaattcgttcagtggcaggctgggattctggctgttaaagtcttctcgaaactggctgatggagagatcgaaagtaggggctccagccagcagataaggcgcggtcgttgccgtatctggtgtttgtgcatgcgcctctgttgtaacggttaatgcagaacataagagaaaaaacagcgtacaccctggcttcattgacagtaccttttgttatgactggctccgattaaaacgatatctgtcgcccttgtcaaaagggtagaatcctggaaaagacaaccatcaaggaacttacatgaccatacagcaatggttattctcatttaaagggcgtattggacgccgtgatttctggatttggataggcctgtggttcgcaggcatgctggtgcttttctcactggcgggtaagaatctactcgatattcagaccgcggcgttttgccttgtgtgcttgctctggccaacagcggcagtaactgttaagcgcttgcatgatcgcgggcgttccggcgcatgggcatttctgatgattgtggcgtggatgctgctggcgggtaactgggcgattttaccgggtgtctggcaatgggcggtggggcgttttgtcccgacgttgattctggtgatgatgcttatcgatcttggtgcgtttgttggcacacaaggcgaaaataaatatggtaaagatactcaggatgtgaagtataaagccgacaataaatcaagtaattaacctttaatatatctcttactgctatttttttccgggattgttatttccacgatgcaaatgacaatacccggaaaatccttctgaactcttcaccttaagcaatatcaaaaaaaatggtaatccataagatcattacttgtttgttcttcccttaacggcgcattattcttaagtcgtaatcgacagagaggcgaatatacagaggtgccctatgaaagatgtcgtagataaatgcagtactaaaggatgtgcgattgatatcggtacggtgattgataacgacaactgtaccagtaagttttcgcgcttttttgccacccgcgaagaagcagagtcttttatgaccaaactgaaagagcttgccgccgctacatcctctgcagatgaaggggccagcgtggcctataagattaaggatctggaggggcaagttgagcttgatgcggccttcactttctcatgccaggccgagatgattatttttgagttatcactgcgttcgttagcttgatggagttgctttagaaggagttaaacatggcttataaacacattggcgtggcaatttccgggaatgaagaagatgccttactggtgaataaagccctggagctcgccagacataatgacgctcacctgacgttaattcatattgatgatggcttaagcgagttgtatccgggtatctacttccctgcaacagaagatattcttcaattgttgaagaataagtcggataacaagctgtataaactgacgaaaaatattcaatggccgaagacaaaactgcgtattgaacgcggagaaatgccggaaacactgctggaaattatgcaaaaagagcagtgcgacctccttgtctgtggtcatcatcactcatttatcaaccgtttgatgccggcatatcgcgggatgatcaataagatgagtgcggatttgctcatcgtgccgtttatcgataagtaaccgcttaccagtaatgctccgctgtcatatggcccggtcggcgacgtaaatgtttcgtcatctgccgggtctctttcagcaactgttgtgtatcgcgcaccatctgtggattgccgcacagcatcacatggctggtttctttattcatcggcaggccaatcgtgctttccagttccccactttcaattaatgccggtatccgtccggtgagcgaccccgctgccgtttcccgactgaccaccgtctgaatgcgcagttttccttcgtagcgtttttccagttcctgcatcagtggcaaatagcttaagtcggcggcataacgtgcggcgtgcaccaggaccagatttttgaagcgatctaaatctttacctagttgcagaatcgataaataagggccaatcgctgtaccggttgccagcatccatagcgtttcgcagtgcggcacttcatcgagcacaaagaatcctgccgcttcgctaaccacctgcacttcatcgcctggtttcagtgccgccagtcgtgggcttaatttgccatcggggacggtgaccaggtaaaactccagatcgggattatcgggcgagtttacataggagtaggcgcgctggacgcgttcgccgtcgatttcaaggccaagcttggtaaattgcccggcggtaaacggaagcacgggggcgtgaacggtgagactaaacagggcgtcggtccagttctgcactttagtgactttgcctgttacccaatcagccatgtttttctcctgttttgattgacttgccttatcttcgttctccgaacaaaaaaattccagtcccgaaggactggaaggctcaatcgatcaaatcaatcagaggatgtgcacctgcatttccgggtctttgcgatccagatagtggatggactgaatgcggcgaatggtgcgtgacttgccgcggatcagcagcgtttcggtagtcgcgatattgcctttgcggctaatgccttccagcagatcgcctttggtaataccggtggcagagaagatgacgttatcgctgcgcgccatatcgcccaggcgcaatactttaccggcttcgatgcccatcgctttgcagcgtgccagctcctgctcgccaatgcgacgattctcttcgttgtcgcctttgacgtcatgacgcgccagcagacgaccgttcatgtcgccatctaatgcgcggatcaccgccgcagaaactacgccttccggcgcgccaccaataccgtacagcacgtcaacttcgctgtctggcatacaggtgagaattgaggccgcaacgtcgccgtccggaatagcaaatacgcgtacgccgagttgctgcatttcagcgataacggcatcgtggcgtggtttagccagaatcgttaccgtcagttcgctcaacggtttgccgagcgccgccgctacattgcgcaggttatccgccagcggcaggttcagatcaatggtgcctttggctcccggcccgacaatcagcttctccatatacatatccggcgcattgaggaagcagcctttatcgcctactgccagcaccgccagcgcgttagcctggcccatcgccgtcatgcgcgtgccttcaatcggatcaacagcaatatctaccgcgtcgccgcgaccagtaccgactttttcaccaatgtagagcatcggtgcttcgtcgatttcaccttcaccaatgacgatggtgccgtcaatgttgacctggttgagcataatacgcatggcgtttaccgccgcgccgtccgcggtgtttttatcgccgcgtcctaaccatttgtagccagccagcgccgctgattcggtgacgcgggaaaattcgatggcaagttctcgtctcatagcaaactctaagcagtaaggaatggcgcgaagtgtagcacaggggaagggagggattattgatgtgtgcggggttgcccccgcacgtttcgggactaccggatgcggcataaacgcttcattcggcatttacattattcgtcgtgttcttcccacgccatcgcgcgtttaaccgcttttttccagcctgcgtaacggtaattacgctcagtggtttcgatgcctggacggaactcgcgctcaatcaccgctttctcttgcagctcgtcgaggttctgccagaagccaaccgccaggcctgcgagataggccgcacccaatgcggtgacttcgcgcacttccgggcgctcaacgcgggtgccgagaatatcggactggaactgcatcaggaaattgtttgctactgcgccaccatccacgcgcagggcgtgcagacggataccagagtcggcctgcatcgcttccagcacgtcacgcgtctgataagcaatagactccagcgtcgcgcgtataatgtggttagcgttcaccccacgagtcagaccgaaaatcgccccgcgcgcatacgggtcccagtacggcgcacccagcccggtaaatgccggaaccacatacacaccattggtgttttgcactttggtggcgaaatattcggaatcgtaggcgtcgttaatcaacttcatttcatcgcgcagccactgaatggatgcgcctgccataaacaccgcaccttccaacgcatagttcacttcgccagtcgggccgcaggcgatggtggtcagcaggccgttttctgatttcaccgctttctcgccagtgttcatcagcataaagcagccagtgccataggtgttcttcgccatcccttctttcacgcacaactgaccaaacagcgcggcctgctggtcaccggcgatcccggagattggaatacgcgtgccgcctttgccgccaatgttagtctgaccgtatacttcggaagaacgacgcacttctggcagcatctcgcgcggaatatccagcacttccagcattttgtcgtcccagtccagggtatggatgttgaacaacatggtacgagaggcgttggtgtaatcggtcacatggacacggccctgagtcattttccagataagccacgtatcaaccgtaccaaacagcaattcaccacgacgtgcacgctcgcgagagccttccacatggtcgaggatccacttcactttggtgccagaaaagtacgggtcaatcaccagaccggtattgctgcggatataatcttctaaaccgtcacgttttaaatgctcgcagatttctgcggtacgacggcactgccagacaatggcgttatagataggcttgccggtttctttttcccagacaatagtggtttcacgctggttcgtaataccgatagctgcaatttgatcggaactgatatcggctttcgccagcacttctaccagcgtggagctttgggtggcccagatttccattgggtcgtgttctacccaacctggttttgggtagatttgctcaaattcgcgctgcgacacgctaatgatattggcatcgtgatccattacgaccgcgcgggagctggtggtgccctggtcgagcgcaacgatatattttttttcagtcatgtttaattgtcccgtagtcatattacagcgaagctttttgttctgaaggagttgtggtttccttttcttccacaacacagatatcgcaaggcaaatggcgaccaatcagtttgcggtaggcaaatgcacctacaatcgcgccaacgatagggccgaaaagcggcaccaggaagtaaggaatgtctctgccgccggtaaaggcgacattgccccagcccgccagccaggcaaagactttcggaccgaagtcacgcgctgggttcatggcaaaacctgtcaatgggcccatagatgcgccaatgaccgcaatcagtagaccaatcagcaagggagccaaagggccgcgtggtacaccgttgccatcgtccgttaacgccaggatcagccccatcagaatagcggtaatcaccatctcaactgcgaaagcctgcacaaaattgatatgaggattagggtaagtagagaaagtgccagccagatcaacactttcaacgctgccgcgaacaatgtgatgagtctgctcgaagtcgaaaaataaattgtagtaaagcccgtaaactaaagccgcagcacagaaagcgccggcaacttgtgaaacgataaaaggaataactttgcgcttgtcgaaacaggcaaacagccacaatgcaatggtaacagcgggattaagatgcgcgccggaaacccctgcggtcaggtagatggccattgccacccccagtccccaaatgacactgatttcccactgaccaaaagacgcaccagcgacttttagtgctgcaacgcaacccacaccgaagaaaatcaacaacccggtaccgaggaattcagcaatgcactggcctttcaaggttgatgtttgactcataatcggatcctgaagagttaatgtttgttgtatgcgtgaaagtcacggacctccacgatgcttgtaggcatgctgtaaacttatcgttaacgagcaaaaacgagaaatatcgaacttaaaatgtgtgtgcctcgtcataaaatgagcgttatcgcgccatttattccatctgattgtacatgatgcatgtttgttagatcattcgcgcaacaaatttattaacattttcgattgatgtggattatgtcaccaggagaaggatgaaaagtgtggcaaaccgtaatctgcaaggcgtgccgctggacagcgatggcgcggcttcatacaatcggagctaactaaagtgcgctcgtatttattaaggcgtcaccggtaatcgggacgaggatttttatccatcaacgccttgcaattcaggagaggtatgacaatgtcattagaagtgtttgagaaactggaagcaaaagtacagcaggcgattgataccatcactctgttgcagatggaaatcgaagagctgaaagaaaaaaacaactcactgtcgcaggaagttcaaaatgcccagcatcagcgcgaagagctggagcgtgagaacaaccatctgaaagaacagcagaacggctggcaggaacgtctgcaggccctgctgggtcgcatggaagaggtctgattacgcttcatcttccgcgtaatttctttactgtgtaggccaacaggtaacgcagaaaaaaggcaccttgcggtgcctttcttatcattcaatatccagcggatcttctgaaagaataatcccggtattgtcggcataaagatggtcgccggagaagaaggtgacaccgccaaaattgacgcggacatcgctttcgccaatgccttcgccagcggcaccaaccggaattgccgccatcgcctggatgccgatatccaactcttccaggtcatctacctgacgcaccgcgccgtaaatgaccagaccttcccattcattttgtactgccagacgcgccagttcagcatcgaccagtgcgcgacgaacagaaccaccgccatcgacgacaagaacacgaccacggccattctgttcgagcagatcgtacagcaacccgttgtcctcgaaacattttaccgtgattatttgtccgccaaacgacgcccgtccgccaaagttggagaacagcggttccacgacgttaacatcttcttgatagatgtcacaaagctcggaagtatcgtatttcataggcttaacattcagttgctgcgagaattttcagtatatcgcgctatgtgggctgttggcaaaatcatcaattgttaattgatatttgtcagttatgctgcccactggcttaggaatatccctaaaacaaacagcaggttagtcagtaacgctcccttgacagtacgttccagcattggtcgcatcgccaccgggtccatttcccgcatcacataacgggcttgcttcaccagtaatggtgccgccagcaggaacagccagccccacaggctatgcagcgaaaagagattaaacagcgccagacacaccagcgagcccatcagcaggcaggcatgataacgacgcgcgttcacttcacctaagcgcaccaccagcgtgtttttgccattttcgcggtcgctattgatatcacgcaggttattaatattcagtactgccgttgccagcaggccgcatgcggtcgccggaaggatcagtgccggaatcaatgtatgagcctgtaaataccagctccccatgacactcaaccagccaaagaaaaccagtacggaaatatcacccagaccgatataaccataaggacgattgcccacggtgtaggtgatagcggcaatgatcgacaacccgccaagaatcaggaaaccgacaaaatcggccagcgtatggcatgccactgcaaccagtgccagcccggagagacagatgagcacgacggtaataatgagcgcccgtttcatctcttgctgggtaatgacccctttttgcatgccgcgtagcggcccaatgcggtcaggtttatcgctgccttttaccgcatcgccgtaatcattggcgaggttagaaaggatctgtaatagcccggcggtaattagtgccagcagggcgaccagcggatcgaagtgaccttgccaccatgccagcgctgtcccgacgataattgcagcaaaggcgagggggagggttttaggtcgtaaactttccagccacgcctgagttcggctaatttgttgttcagtcataatacgcgccaataaaaatggggcctttcagccccatcaaacaatgatgaaaatgattgaacgcgattataggataaaacggctcagatcttcatctgccaccaacgcatccagatgtttgctcacataatctgcgtcaatagtgatattttgaccgcttaaatcgctggcgtcgtaggaaatctcttccattaaacgctccagaacagtgtgtaaacgacgagcaccgatgttttcggtagattcgttcacctgccatgccgcttccgcgatgcgtttaataccggagtcggtaaactcgatatttacgccttcagtcgccatcagtgctttgtactgcacggtgatagaggcattcggctcggtcagaatacgctcgaagtcgctggtggtcagcgcctgcagttcaacgcggattggcagacgaccttgcagttccgggatcaggtcagacggtttcgcaatctggaacgcgccagaagcgataaacagaatgtggtcagttttgaccatcccgtgtttggtggaaacggtgcaaccttctaccagcggcagcaggtcacgctgaacgccttcacgagaaacatccggaccggaagactcgccgcgcttacagattttgtcgatttcgtcgataaacacgatcccgtgctgctcaacagcgtcgatagcgtcttgcttcagctcttccgggttcaccagtttcgccgcttcttcttcaatcagcagcttcatggcgtctttgattttcagcttacgcgctttttgcttctggccgcccaggttctggaacatggactgcagctggctggtcatctcttccatgcccggaggagccataatttcaacgcccatcggtgctgcggcaagatcgatctcgatttctttgtcatcaagctggccttcacgcagttttttgcggaatgcctgacgagcagcggacggttcctgctgctgttcggtctgtccccagttgtttttagcaggtgggatcagcacgtcgagaatacgttcttctgccagttcttcagcgcgataacggtttttctcgatagcctggacgcgtaccattttcacggcggcatcggtcagatcgcgaataatagaatccacttccttaccgacgtagcccacttcggtgaatttggtcgcttcaactttgatgaacggcgcattcgccagcttagccagacgacgggcgatttcagttttaccgacaccggtcgggccgatcatcaggatatttttcggggtcacttcatggcgcagctcttcgttgagctgcatgcgacgccagcggttacgcagagcaatcgccacagaacgcttggcgttgtcctggccgatgatgtgcttatccagttcgctgacgatttcgcgtggggtcatttcagacatgggagatccttacgctttgtagcttaattcttcgatggtgtggaaatggttggtatagatgcaaatgtcgcctgcaatatccaacgccttttcagcaatttcacgggcgctaagttcagtgttttctaacagcgcgcgcgccgcagcctgggcgtaagggccgccggagccgatagcaataagatcgttttctggctgcaccacgtcaccgttaccggtgatgataagcgatgcagtttcatccgcgactgccagcagtgcttcaagtttgcgcagcatgcgatcggtacgccagtcttttgccagctcaacggcggctttgaccagatggccctgatgcatttccagtttacgttcaaacagttcgaacagcgtaaaagcatccgcagtaccgcccgcaaagcccgcgatgactttgtcgttgtacagacggcggacctttttcacgttgcctttcattacggtattgcccaacgtggcctgaccatcaccagcgatgaccacatggccgttacggcgtacgcttactatagttgtcacgagctgaccccttggttacgaatacagagtacaaaccccgtacaaaagtacggggcataatgcaattatagatgggggggattttgagggtttcaacccccggcggcgagccgaatgcagtttgtatgacccgccatcttcaaccgattgagggtgctgtctgcgttctctttgcctttcaccgggccaatgaccacacgattccagccattgttggtggtgattttcgagtcaaagccttcgaacgccagctgagcacgtaccgtctctgcctgttccgcgcctctgaacgaaccgcactgcaccatccagcggcgttcgtcttttttctccgccgtcggttttggcgcgtcagcggcacgagcaactggcgcagcttgctgcggcttcgactgcgcagtcgtgtgcgcaggagtttgcagcagatcctggtacggctgctgagaagaagccggtttagactggcgcggttgcgcctgtaccggtgcggcttgcgacgtacgcgtctgctgctgccagctttgttcagtcgtacgcgactgctgagccaggcgttgctgttccgctaattgctgcgcctgacgttggcgctgtagcgtttgctgacgctgttccggcgtctgttcattccacggaacttcaaccagctgcgttggctgctggcgcatatcagcctgcatttgttcaagaagctgacgttgttctggtgtcagttgctccggcgttttcacttcaccaccggcagaaggttctgtgggcgcacgcactcccggctggcgactttccagctctttaatgtagcgccagcgttcttctggttttggtggtagtccgtttccggtcactttctggctttgcagcgtctcggactcttctttcttgtgatgcgtaatgaagtacagaccaccgataaaggtcacaagaacggcggcagcaatagcgaccatagcgggagaaaccgcaggcagatttcgttgctttttccgtgaggtgctcttttttcgccgcgaaggtgccggttggctgcggcgtacataatctcgttgtgccactatcgtttcgctgtatttattcgttcgtcagcccgccatgttacttaagcggcgggcctttgaccagtcacggcagtcttaaaggtttactttaaggtaacgcgcgtgttgatccccggatgataagttcgcagtccattaaacgagagccactgccaacgtgttgcccctgcatttgatcaagcaataacagcatagcttcccgaccgatttcgtaacgcggctgcgcgatggttgtcagcggcggatcacaaaattgcgtcaggtcgatgttatcaaaaccgattatggaaaggtcttccgggactttcagcccctggcgttttgcctgagaaagtgcgccgagcgccatcacatcgctatggcagaagacagcagtaggcggttgtggaagatcaagcagctgctgcatcgctttgcttccggcttcgaaggtgaagtcgccacgggcgatgtattgcggatcaaccataatgccgcagcgacgcagcgcctgaacatagccttgcaggcggtagtgacacagcggcatctcttcgggaccggctatacagccaatccgtttatgcccttgctcatataaataatttactgcatcaaatgcggcggtcagattgtcgatatgaactgtaggcagctccagctccggtgcaaattcgttcgccatcaccatcggcggcagattacgctgttcctcaatgctggcatcaaacggcagccttgaacccagcaacaacatgccatcaatttgcttggtgatgatcaaatcgataaaggttttttcctgctgattttgatgcgcacagtcgccaatcagcaccagatatccgtgatttgccgccgtaacttcgataccgcgaataatttcgctaaagaagggatcgcagatatccgggacaatcaccagaatggtgcgggattcattacgcttgacgttgcgccccataggctgcggtaaataacccacttcccgggccgctttttcaacccgattacgggtggcctgggagactttatcgggattcattaatgctcgggagacggtcgctgtagagacttttgccttgagggcaacgtctttcatggtcgcggcagtttcctgcttcttcgctttcacactcactcctcgcctggcacgtcaggcgtactacatccatgtttacttcacatcggcaacatttttagcagatagcgcgtgaaaacggttacagaattttcatgaaaagtgtgatgaatattgaatttttcgatccgcctcgcatcgtgagcggtttaaccctcaatcggatcaacatccagcacccatttcaccttacgggaatccggtattgtattgatgagcgccagcgtaccgttaatgatgtgttgcaagcgcacgcgggaagggtgctgcaacaatatctgccagcgccagcgaccgccacgtttaggtgccagagccggaaccggaccgagaacccacagtttctcgtctgccagtgggctggagaggatcagattacgcagttgttgcaggaacaatggcgcgtgctgattgttatgatcttccgcacgcacaatcacatggctggtccacggcggtagctgcatcattcgccgctcagccagcgcctgttcggcaaaggcgtcgtagcctttatagagcaacgtttgcaacagaggatgttccggatggtgcgtttgcagcaccacttcgccctgtttacccgcacgcccggcacgaccggcgacctgggtgtaaagctgagcgaaacgctctgccgagcgaaaatcggcagaaaacagcgcgccgtccacgtccagtaatgcaaccagcgtcacatccgggaaatggtgacctttcgccagcatttgtgtaccaatcaaaatccgcgcgccgccgcgatgtacttctgccagttgctgttccagcgcccctttgcggctggtggtatcgcggtcgatacgagaaatgggcacgccggggaacaacggcgcgagcgtctgttcaagctgttcggtgcccagccccacggggaccaggtgcgtggaaccgcaggaagggcactggcgcggcaccggacgctgactgtcacagtggtggcagcgcagatggtgctgcgcctgatgcagcgtgtagtagtgatcgcaacgtgggcattcggcaatccagccacagtcgtggcacagcagtgcaggcgcaaagccacggcggttaagaaagagaatgacctggttatcagcctgtaaatgctggcgcatacgagtgattaacgccggagccagacctgcctgcaccttctgaccttttaaatccagcacatgttgaattgccggacgcgcattccctgcccgacgggtcaggcgcagcaggcggtattttttctgctggacgttgcataacgtttccagcgcgggcgttgcggagccaagaataatcgggatttgctcgctgtgcgcacgatacaccgccaggtcgcgggcatgatagcgccagccttcctgctgcttgtaggagctgtcgtgctcttcatcaatgacaatcacgccgagatttttaaacggcgtaaacagcgcggagcgggtgccgatcacaatcgccgcctcaccatttttcgctttcagccacgccgaaagacgctcgctgtcgttcaggccggaatgcagaacttccacgggggcattaaaacgttcacgaaaacgggcgatagtttgcggtgtcaggccgatttccggcaccatcaccagcgcctgtttgccctgagcgagcacgttttccagtacgctgagataaacctccgttttaccggaaccggtaacgcccgccagcagccaggcagaaaaagtatctgccgcgctatgaattgcgccaacggcggtggcctgttcggtattcaatcgcaaccgctcaccagaaacggcatagttcgttcgccagtcgctaaactctggtgtttcacttgctaaatcacacagaccttttttgcgtagcgcctgcaacgcggcatcattaaattcgagcgtggcgacctggtcgcgccagattttgccttgccgtaacgccgccagcgcctgttgttgcttgggggagcgtttcaggctgttcagatccaccgcctggccttgttcagtggcaaaccagtaccacatcggcgcgttcgccgcaggccgcccctggcgtagtaaaatcggcaaggcatgaaacagcacatcgccaatcggatgatgatagtaatctgccgcccatagcagcaatcgccagacggagtgagtaaacaccggctcactatccagcacttcgactaccgcttttagctcattgagcggcagttcgctggcatcgctaactgataccacaatcccgatgcgctcctgctgtttgccaaacggcacgcgcacgcgacacccagctttaaccgtcatgccttctggcagcagatagtcaaaggtacgaggaagcggaacgggcaaggcaacgtgggcaacgggcatagcatcatcctgacttgaaattcggtgggttagtatacacattgccgtagaagagtgcggatcagtttgcatacgctggttaatttctgtatgatttcgcgccttcgtacgaaatgatcgtattgaagctatacttttaacatcgcgtggtgtctggcgttagggctggaagagcgacgcggccttaaaccgaggttttcccatgaaaaaagatattcacccgaaatacgaagaaattactgctagctgctcttgcggtaacgtaatgaaaatccgctccaccgttggtcatgacctgaacctcgacgtgtgcagcaagtgccacccgttcttcactggcaaacagcgtgatgttgctaccggtggccgtgttgaccgcttcaacaagcgtttcaacatcccgggcagcaaataagaccggatttccgaaaaaagcgccgcacggcgctttttttgtgcctgaattttggtcgtattaccacgaaaacagcggccattctttggcgaccgtggtgagttgtggcgcatcgaaaacggcttgtggcgagaccaccgtttcctcaagcggaatattcttgccgtaacgttctttgagctttgcctgaacttgtgggctgctcaggtcgaactctttcaacttctgctgctcgcccacgcgcattcccagcgcgttctggtaaaccttccacaccacttccgaacagtactggcgatcgtcgctccatgagaagctgaaatcatacggtttaccgagataacgttttgccgtttgcgccagtttttgctgttgttcaacactcagtccgccttcaacgcggcgaacaacgtatttgcccttttcaccatgggcgatccactgcttgagcggggtgtatttcaccgggccgactgcttcaaaaacgtagggctttttgttgcgtatcaccagcataccggtgtggctataatcggtatgggtcgccagttggatcgctttactttgcgatgagcgagagatctgaaagatgatgtcgccggtttgtggctgccaggcaaaggcaggtacagaaaccagcaggctgaggatcagcagcctgtttttcatagttaaacgtccatgtataaaaagcggtgggtcgcagacaacgtgctcgttgtttatgccggatgcggcgtgaacgccttatccggcctacaagttcgtgcaaattcaataaattgcaatatgacgtaggcctgataagcgtagcgcatcaggcgattccactccgcgccgctcttttttgctttagtattcccacgtctccgggttaatccccatctcacgcatgatctcttttgccgcttccgggatttcgtcgctgcgctctttacgcagatcggcatcatccggcaaaggttgcccggtaaaggcatgcagaaacgcttcgcacagcagctcgctgttggtagcgtgacgcaggttgttcacctgacgacgcgtgcgttcatcggtgaggatttttaacaccttaagaggaatggaaaccgtaatctttttgacttgttcactcttcttgccgtgctcagcgtatgggctgatatattcgccgctccattcagccatgagatacttaatcctcttcgtcaataaattgagaccagaccacacagttgatgtgggtactgaccgtaaacccgcatagtttaccgtacaggcgttaccgtgacatcgtgtaatgcacctgtcggcgtgataatgcatataattttaacggctatttgggatttgctcaatctatacgcaaagaagtttagatgtccagatgtattgacgtccattaacacaatgtttactctggtgcctgacatttcaccgacaaagcccagggaacttcatcacatgacgcgtaaacaggccaccatcgcagtgcgtagcgggttaaatgacgacgaacagtatggttgcgttgtcccaccgatccatctttccagcacctataactttaccggatttaatgaaccgcgcgcgcatgattactcgcgtcgcggcaacccaacgcgcgatgtggttcagcgtgcgctggcagaactggaaggtggtgctggtgcagtacttactaataccggcatgtccgcgattcacctggtaacgaccgtctttttgaaacctggcgatctgctggttgcgccgcacgactgctacggcggtagctatcgcctgttcgacagtctggcgaaacgcggttgctatcgcgtgttgtttgttgatcaaggcgatgaacaggcattacgggcagcgctggcagaaaaacccaaactggtactggtagaaagcccaagtaatccattgttacgcgtcgtggatattgcgaaaatctgccatctggcaagggaagtcggggcggtgagcgtggtggataacaccttcttaagcccggcattacaaaatccgctggcattaggtgccgatctggtgttgcattcatgcacgaaatatctgaacggtcactcagacgtagtggccggcgtggtgattgctaaagacccggacgttgtcactgaactggcctggtgggcaaacaatattggcgtgacgggcggcgcgtttgacagctatctgctgctacgtgggttgcgaacgctggtgccgcgtatggagctggcgcagcgcaacgcgcaggcgattgtgaaatacctgcaaacccagccgttggtgaaaaaactgtatcacccgtcgttgccggaaaatcaggggcatgaaattgccgcgcgccagcaaaaaggctttggcgcaatgttgagttttgaactggatggcgatgagcagacgctgcgtcgtttcctgggcgggctgtcgttgtttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaaaaatgagtgtgattgcgcaggcaggggcgaaaggtcgtcagctgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacgctgcgtcgctatcagtgcgatctgattagcggtctgctacccgctgaagaagccgatagcctcattagcgcttttgtcagcgaccttgagcgcctggcggcgctgctcgacagcggtattaacgacgcagtgtatgcggaagtggtgggccacggggaagtatggtcggcacgtctgatgtctgcggtacttaatcaacaagggctgccagcggcctggcttgatgcccgcgagtttttacgcgctgaacgcgccgcacaaccgcaggttgatgaagggctttcttacccgttgctgcaacagctgctggtgcaacatccgggcaaacgtctggtggtgaccggatttatcagccgcaacaacgccggtgaaacggtgctgctggggcgtaacggttccgactattccgcgacacaaatcggtgcgctggcgggtgtttctcgcgtaaccatctggagcgacgtcgccggggtatacagtgccgacccgcgtaaagtgaaagatgcctgcctgctgccgttgctgcgtctggatgaggccagcgaactggcgcgcctggcggctcccgttcttcacgcccgtactttacagccggtttctggcagcgaaatcgacctgcaactgcgctgtagctacacgccggatcaaggttccacgcgcattgaacgcgtgctggcctccggtactggtgcgcgtattgtcaccagccacgatgatgtctgtttgattgagtttcaggtgcccgccagtcaggatttcaaactggcgcataaagagatcgaccaaatcctgaaacgcgcgcaggtacgcccgctggcggttggcgtacataacgatcgccagttgctgcaattttgctacacctcagaagtggccgacagtgcgctgaaaatcctcgacgaagcgggattacctggcgaactgcgcctgcgtcaggggctggcgctggtggcgatggtcggtgcaggcgtcacccgtaacccgctgcattgccaccgcttctggcagcaactgaaaggccagccggtcgaatttacctggcagtccgatgacggcatcagcctggtggcagtactgcgcaccggcccgaccgaaagcctgattcaggggctgcatcagtccgtcttccgcgcagaaaaacgcatcggcctggtattgttcggtaagggcaatatcggttcccgttggctggaactgttcgcccgtgagcagagcacgctttcggcacgtaccggctttgagtttgtgctggcaggtgtggtggacagccgccgcagcctgttgagctatgacgggctggacgccagccgcgcgttagccttcttcaacgatgaagcggttgagcaggatgaagagtcgttgttcctgtggatgcgcgcccatccgtatgatgatttagtggtgctggacgttaccgccagccagcagcttgctgatcagtatcttgatttcgccagccacggtttccacgttatcagcgccaacaaactggcgggagccagcgacagcaataaatatcgccagatccacgacgccttcgaaaaaaccgggcgtcactggctgtacaatgccaccgtcggtgcgggcttgccgatcaaccacaccgtgcgcgatctgatcgacagcggcgatactattttgtcgatcagcgggatcttctccggcacgctctcctggctgttcctgcaattcgacggtagcgtgccgtttaccgagctggtggatcaggcgtggcagcagggcttaaccgaacctgacccgcgtgacgatctctctggcaaagacgtgatgcgcaagctggtgattctggcgcgtgaagcaggttacaacatcgaaccggatcaggtacgtgtggaatcgctggtgcctgctcattgcgaaggcggcagcatcgaccatttctttgaaaatggcgatgaactgaacgagcagatggtgcaacggctggaagcggcccgcgaaatggggctggtgctgcgctacgtggcgcgtttcgatgccaacggtaaagcgcgtgtaggcgtggaagcggtgcgtgaagatcatccgttggcatcactgctgccgtgcgataacgtctttgccatcgaaagccgctggtatcgcgataaccctctggtgatccgcggacctggcgctgggcgcgacgtcaccgccggggcgattcagtcggatatcaaccggctggcacagttgttgtaatttcagaaatttaataatgcccggtactcatgttttcgggtttatggtttctaatgaaatatattgaattatcataggattaggccggattaagcgtttacgacgaatccggcaagaagcaataagtacatggttagtttatatttgcagtccggtttgctttgcataccggattttctttttcttaccatcctgaagttttttcatcttccctgatttttcctcaccatcattggtcatttttcggttgacgcccttcggcttttccttcatctttacatctggacgtctaaacggatagatgtgcacaacacaacatataactacaagcgattgatgaggtaaggtatgagcttttttcacgccagccagcgggatgccctgaatcagagcctggcagaagtccaggggcagattaacgtttcgttcgagtttttcccgccgcgtaccagtgaaatggagcagaccctgtggaactccatcgatcgccttagcagcctgaaaccgaagtttgtatcggtgacctatggcgcgaactccggcgagcgcgaccgtacgcacagcattattaaaggcattaaagatcgcactggtctggaagcggcaccgcatcttacttgcattgatgcgacgcccgacgagctgcgcaccattgcacgcgactactggaataacggtattcgtcatatcgtggcgctgcgtggcgatctgccgccgggaagtggtaagccagaaatgtatgcttctgacctggtgacgctgttaaaagaagtggcagatttcgatatctccgtggcggcgtatccggaagttcacccggaagcaaaaagcgctcaggcggatttgcttaatctgaaacgcaaagtggatgccggagccaaccgcgcgattactcagttcttcttcgatgtcgaaagctacctgcgttttcgtgaccgctgtgtatcggcgggcattgatgtggaaattattccgggaattttgccggtatctaactttaaacaggcgaagaaatttgccgatatgaccaacgtgcgtattccggcgtggatggcgcaaatgttcgacggtctggatgatgatgccgaaacccgcaaactggttggcgcgaatattgccatggatatggtgaagattttaagccgtgaaggagtgaaagatttccacttctatacgcttaaccgtgctgaaatgagttacgcgatttgccatacgctgggggttcgacctggtttataaatagtgtggcttttgtgaaaatcacacagtgatcacaaattttaaacagagcacaaaatgctgcctcgaaatgagggcgggaaaataaggttatcagccttgttttctccctcattacttgaaggatatgaagctaaaacccttttttataaagcatttgtccgaattcggacataatcaaaaaagcttaattaagatcaatttgatctacatctctttaaccaacaatatgtaagatctcaactatcgcatccgtggattaattcaattataacttctctctaacgctgtgtatcgtaacggtaacactgtagaggggagcacattgatgagcacgtcagacgatatccataacaccacagccactggcaaatgcccgttccatcagggcggtcacgaccagagtgcgggggcgggcacaaccactcgcgactggtggccaaatcaacttcgtgttgacctgttaaaccaacattctaatcgttctaacccactgggtgaggactttgactaccgcaaagaattcagcaaattagattactacggcctgaaaaaagatctgaaagccctgttgacagaatctcaaccgtggtggccagccgactggggcagttacgccggtctgtttattcgtatggcctggcacggcgcggggacttaccgttcaatcgatggacgcggtggcgcgggtcgtggtcagcaacgttttgcaccgctgaactcctggccggataacgtaagcctcgataaagcgcgtcgcctgttgtggccaatcaaacagaaatatggtcagaaaatctcctgggccgacctgtttatcctcgcgggtaacgtggcgctagaaaactccggcttccgtaccttcggttttggtgccggtcgtgaagacgtctgggaaccggatctggatgttaactggggtgatgaaaaagcctggctgactcaccgtcatccggaagcgctggcgaaagcaccgctgggtgcaaccgagatgggtctgatttacgttaacccggaaggcccggatcacagcggcgaaccgctttctgcggcagcagctatccgcgcgaccttcggcaacatgggcatgaacgacgaagaaaccgtggcgctgattgcgggtggtcatacgctgggtaaaacccacggtgccggtccgacatcaaatgtaggtcctgatccagaagctgcaccgattgaagaacaaggtttaggttgggcgagcacttacggcagcggcgttggcgcagatgccattacctctggtctggaagtagtctggacccagacgccgacccagtggagcaactatttcttcgagaacctgttcaagtatgagtgggtacagacccgcagcccggctggcgcaatccagttcgaagcggtagacgcaccggaaattatcccggatccgtttgatccgtcgaagaaacgtaaaccgacaatgctggtgaccgacctgacgctgcgttttgatcctgagttcgagaagatctctcgtcgtttcctcaacgatccgcaggcgttcaacgaagcctttgcccgtgcctggttcaaactgacgcacagggatatggggccgaaatctcgctacatcgggccggaagtgccgaaagaagatctgatctggcaagatccgctgccgcagccgatctacaacccgaccgagcaggacattatcgatctgaaattcgcgattgcggattctggtctgtctgttagtgagctggtatcggtggcctgggcatctgcttctaccttccgtggtggcgacaaacgcggtggtgccaacggtgcgcgtctggcattaatgccgcagcgcgactgggatgtgaacgccgcagccgttcgtgctctgcctgttctggagaaaatccagaaagagtctggtaaagcctcgctggcggatatcatagtgctggctggtgtggttggtgttgagaaagccgcaagcgccgcaggtttgagcattcatgtaccgtttgcgccgggtcgcgttgatgcgcgtcaggatcagactgacattgagatgtttgagctgctggagccaattgctgacggtttccgtaactatcgcgctcgtctggacgtttccaccaccgagtcactgctgatcgacaaagcacagcaactgacgctgaccgcgccggaaatgactgcgctggtgggcggcatgcgtgtactgggtgccaacttcgatggcagcaaaaacggcgtcttcactgaccgcgttggcgtattgagcaatgacttcttcgtgaacttgctggatatgcgttacgagtggaaagcgaccgacgaatcgaaagagctgttcgaaggccgtgaccgtgaaaccggcgaagtgaaatttacggccagccgtgcggatctggtgtttggttctaactccgtcctgcgtgcggtggcggaagtttacgccagtagcgatgcccacgagaagtttgttaaagacttcgtggcggcatgggtgaaagtgatgaacctcgaccgtttcgacctgctgtaatctgaccccgttcagcggctgcttgctggcagtcgctgaacgttctttaccagcgtatagtgggcgaacgaaaactacacactggatctctcatgtctgccgcaggaaagagcaacccactggcaatcagtggcctggttgtgctcacacttatctggagttatagctggattttcatgaagcaagtcaccagttacatcggtgccttcgactttaccgccttacgctgcattttcggcgctctcgttttattcatcgtccttttattacgtggtcgcggaatgcgcccgacaccgtttaaatacaccttagccattgccctgttacaaacctgcgggatggttggtctggcgcagtgggcgttggtcagcggaggtgcggggaaggtggcgatcctgagctataccatgccgttctgggtggtgattttcgccgcgttgtttctcggtgaacgcctgcgacgtgggcaatatttcgcgattctgattgccgctttcggcttatttttggtgttgcagccgtggcaactcgatttctcttcgatgaaaagtgccatgctggcaatcctctccggcgtcagttggggggcgagcgcgattgttgctaaacgtctgtatgcccgtcatccgcgcgtggatttattgtcgttaacatcctggcagatgctgtatgcggcgctggtgatgagtgtggtcgctttactggtgccgcaacgtgaaattgactggcagcccaccgtgttctgggcgctggcctacagtgcgattctggcgacggcactggcgtggagcttatggttgtttgtattgaaaaacttgcctgccagtattgccagcttaagcacactggccgttcccgtttgcggcgtactcttttcctggtggctgctcggcgagaatccgggggccgttgaaggtagcggtattgtgctgattgtgctggcactggcgctggtgagccgtaagaaaaaagaagccgtcagtgtaaaaaggatctgaattttttcttcatgtggggcgatctcttatttaacaaaataacgataatgccccaccatccgccagttaaacagcacatcttcttcctgcgcgcctgcgccaatgttatgtatcaccagcggcgtaccgtcgcgggcgaagccatctgaaaccaccccaatatgtgccagcccgttatccagtcgccaggagacaatatcgcccgcttgatagtcactggggttcttgctggtggggcgtgttttatcatggcggctaaaccaggtttccagattaggcacccgacggtgatcgatgttgctgtccgggcgctttaacttccatttttgcgggtactcagcaaaattcttcgccatatcttcgtgaaccagtttctgcaaatcgaccttctggctgcgcaatgcgcggatcaccacatcggaacatacaccgcgttcttgcggaacatcaccgccaggataagtaagctgcacatacgccggatcgtaaaatagcgtgctgccaatttgctgtctggcaccgtctgcgatggcaaggttggtattggcctggatttgtaccacggttggtggaacggcgggagattttaaggagtggctggtaaatgccgttagcaggctgagcagcgccagtgaagctttcatctggttcgtccgtgaaaataagagtcacagattcgaccttccgggctaacgattgttctgtagagaaaatgtccagaagcggataaaaaattcctgaacaacgtgggagtttcagattactggcacagagtgccggatgcggagtgaacgccttatccggcctacaaaagcacgcaaattcaatatattgcagagattgcgtaggcctgataagcgtagcgcatcaggcaattttgcgttcaaactcccggacaagccgggagtttggagtaggttattcccactcttgcaggaaacgctgaccgtactggtcggctaccagcagagcggcgtaaacctgatctggcgtcgcgccgccaggcatgttgtgaatggtttcaccttctgcacatgccgcttctgccacaattcgcattttcgccgggacatcttctttaatatccagttgagcgagagttattggcaaacctaccgcatggctaagggcagctacggtttcgatttcctccaccggcgcattttccagaaccagctgcgtcagcgtaccgaatgccactttttcaccgtgataatagtgatgcgcgtccgggatagcggtcaggccgttatgcactgcgtgcgccgcagccagaccaccactttcaaaaccaacaccgctcaaataggtgttcgcttcaatcacgcgctccagcgccggagtcactacatgctgttcggcagcaagcatcgctttttcgccttcttccagcagggtgttgtagcacagttcagccagtgccagcgcagcctgggtgcacttgccgcccgccatggtggtcgcgccgctacgagagcaggcacgcgcttcaaaccaggttgccagcgcatcgccgatacccgccgctaacagacgtgcaggtgcgccagcgacgattttggtgtcgacaatgaccatattcgggttatttggcaacagcagatagcggtcaaactcaccctcatcggtgtagataacagacaatgcgctgcacggtgcatcggtagaggcgatagtcggtgcgatcgctaccggaacacccatgaaatgtgccagtgctttggcagtatcgagggtttttccgccaccgataccgagaattgcgccacactgcgcagtctccgcgatgccacgcagacggtcgatctcattttgcgaacattcaccgccaaacggcgcaatttctactaccagtccagcatctttaaagcttttctcgacagtggattgagcaaaacctaaaacaaatttgtcacccaccactaaccagcgttctgccagcggcttcaggtattcgcccagacgattaatcacatcagcgccctggatgtatttacccggtgattgaataatgcggtccataattgctcctttagagatgagtagtgccaaatgcggcattccagtcgtgttcgaacttctctatagctgactctaccgcaggggtgttgagcatttgttgcgctacatctaagggcagggtgatggattcacatcctgccagtaaacagtccagcgcctgacgcggcgttttaaagctggctgccagcaccatgctttctggcgcgtgcatttctaacagcgtttgcagctcctgaaccgtacgaatgccgtctccgccctgggcatctacgcggttaacatacggagcaacgtattttgcccctgccagtgcggctaataacccttgtgcggcgctatatacagcagtgccaagtgtagtaataccctcttttttcagtattttaattgctgccagaccttcggaagtcaccgggattttcaccacaatacccggaatagcgtcgcgcaggcgcttcgcttcttccaccatcccctgcgcgtcgcggctcatggtctgagcaaacagaatgccctcatcaccaatcgctttttgcagacgcggcagcacttcccatatggactccttgctggcagcgataatgctcgggttagttgtcaccccggcaatggggaatatgcgtgccagacgttcgacttctgcgacgttagcggtgtccagatacagttccatgatgtttccttttacagttccagttcatgttgcagcaggctggcgatagcgtcggcagaggcggcgttaaccagcgcgttacggaattcttcgtgcatgatgcggcgagcgaggcgcgagaaaatgcgcatatgctgatcgcccgcagcgtgtttgttcagggttaacataatgatgaattgcgcttcatcatcgccccagcgcaccggcgcttgcagacgcgccacgctgatggtggattgctcaatgtgttctgatttgctgtgtggaatggcaaaactaaagcccagaccggtagagaaaacggcctcgcgcgcccacaagtcggcttccagtttacgcggatagcggcagcggcccgccagcagcaggttatcggtcatgcctttgagcacttcttctttgctgcgccagtcgctttccagtgtgatgcactcggcggtgaccagcggtgcgtcttgttgggtcatgcggaattgcgccagcaggtgttctacttccagcgaagtacggcaggccattgcctggttgagcaacttgcggcactcacggctatcaagttgcgccatccgagctttcgccgccggaattgatggtgcgctcatgctgagttcatccagccctaagccgaccagcaacggcagcacggaacctttcgctcccagctcaccgcacagaccaatccatttgccctggcgatgcaccgcttgcacggcgtaatcgagcgcccgcaagaatgccggattcaggctgttgtagtgacgagtaaccttagcgttatcgcgatccaccgccagcagatactgcgtcaggtcattactaccaatactaaagaaatcaatctcttcgcagcattgatcgatgatgaacatcaccgacggcacttccagcatgatgccgagctggattttctcatcaaacggaatgtgttcgttacgtagttgctgtttggcttccgccagtttttctttcacccataagatctcttccattgaggagatcatcgggatcatgattttcaggctgccgtgagcggaggcgcggaggatcgaccgtagctgcgtggtaaacaacgacgcgtactcttcataaatacgcacggcgcgataaccgaggaacgggtttgcctctgcgggaatgttcagataatcaacgggtttgtcgccgccaatgtccatagtgcgcacaataatgctgcgtccgttggcggattccagcgcctgacaaaaaatgttgtacaactcgctttcgcccggtgcgctggtgcgatccatatagagcatttcagtgcggaacaaaccaacgccttccgcaccattgccgaatgcggcctgcgcttccacggagtgagcgatgttagcggcaatttcaatgcggataccgtcagcggtacgggcttgttgggtcagccagacacgctgttgctcacgcagggcgtcctgtacgcgggcttcttgctgataataacgagctacggcttcccctggctcaaccacaatcgccccggcgttgccgtcgatataaatcgtttgttgctgccacggagtaagggcatcaatatccacaccaaccagcgttggaatgttgaacgaacgggcaaggatcaccgtatgtgaggtggtgccgccgcttttgagcaacaatcctttgaggtgatttttatccagttcgaggaactggctgggggtcagttcatcagccatacaaatggcgggctgcgtcagtttgcccggtgccgggaagcgttgctcaccgtagatttgctggagtaactggaagcagacgtcgcgtacgtccagggcacgttcttgcaggtagctgctgctggaacgggaaaactcttcgcaaaagtgattcgcgctggcaacaattgcttcggcgcagcttaatccggcgctgacgcctgccagtaaatgttcgcgcagggaagtatcgccagccagggatcggtgagcttccagaatcgcgctggtagcaccgtcgctatccagcagacgaaactcaatgtttttcagtaccagcgtcaggccgttttccagtgcggattgctcggcgtcaacgcctttggctgcgggaagattacccagcgcattgagatctaaagaagagatcggcgtcagaatgccgcctgcactaccgctgcacacggtgcgggcgcggataatttgcggattcagattggtcagtgaaaccggcagtggttccagttcgtcagatttaacttccgccagcggcgcatcgcagtgggggaattcatcgcgcagccattggcttaaacgctggtgcgcttcctgttcgtcggccccggaaatcagtaactggcagttatcgcccgccagcgtatcggtgccaatcagcgcaagggcgcttttggcgttgcccttgcggtcagtgcgcaggttatgccactcaatttgtgatgaaaaagtattacacagcgtttcaacgtggcttgccggacgcgcatgtacgccgttaggtagctcacaaataaattccacaatcagggccattgcctctctcccggtacggttttctgtttacaggataagagcgcacggcaacggcctgccatgtgacaaatctgccaaaagctggacaaatgtaatgtaaccgtcaatttgcgacgcgtctcacaagacgctgttttgcggcatgcttccggtttatcgcaagttatgaggcggatcgcatttttgtactgatattacaaaagtccagtaaatggcctttttatccactgtttgctccgcctgcgattgcctattgtttcctccatcaaaaatatggacatgggctttcgcaagcccgggagcagcttatgaatgagttggtgcagatcctgaaaaatacccgtcagcatttaatgacgggcgtttcacacatgattcccttcgtggtatcgggcggtattttgctggcggtttccgtcatgttgtatggcaaaggcgcagtgccggatgccgtagccgatccaaatctgaaaaaactgtttgatatcggcgttgcgggcttgacgctgatggtgcctttcctcgcagcgtacatcggttattccattgcagagcgttctgcgctggctccgtgcgctatcggtgcctgggttggtaacagctttggtgcgggcttctttggtgcactgatcgccgggattatcggcggcatcgtggtgcattacctgaagaaaattccggtgcataaagttctgcgctcggtgatgcctatcttcattattcctatcgtcggcacactgattaccgcaggcatcatgatgtggggcttgggcgagcctgtaggggcgttgaccaacagcctgactcagtggcttcaggggatgcagcagggcagcattgttatgctggcggtgatcatgggtctgatgctggcgttcgatatgggcggtccggttaacaaagtggcctatgccttcatgctgatttgcgttgctcagggtgtttataccgtggtggccatcgctgccgtgggtatttgtatcccgccgctggggatggggctggcgacgctgattggtcgtaaaaatttctccgcagaagagcgcgaaaccggcaaagcggcactggtgatgggctgtgttggcgttactgaaggggcgattcctttcgccgctgccgatccgctgcgtgtcattccttccatcatggtcggttcagtttgtggtgcagtaactgcggcgctggtcggtgcgcagtgctatgcaggctggggtggtctgattgtgctgccggtggttgaaggcaagctgggttatatcgcagcagtggctgtcggagcagtggtgacggctgtttgtgtgaacgtgctgaaaagtctggcgcgtaaaaatgggtcttcgactgatgaaaaagaagacgacctggatttggattttgaaattaattaattgaggaacgagccatgacgaaaattattgcagtaaccgcatgtccttcaggtgttgcccatacctatatggcagcagaggcgctggaaagtgccgcgaaagcgaaaggctgggaagtgaaagtagaaacccaggggtcaattggtctggaaaatgaactgactgcggaagatgtggcgagcgctgatatggtgattctgaccaaagatatcggcatcaagtttgaagagcgttttgctggcaagaccatcgtgcgcgtcaacatcagcgatgcagtaaaacgtgctgacgccattatgagcaaaattgaagctcacctggcgcaaaccgcttaagttcttctcccgctcgcaagggcgggttcgctttcccacaggagttcctcatgacgaatcgtatctctcgcctcaaaactgcactgtttgccaatacccgtgaaatctcgctggagcgggcgctgctttataccgccagccatcggcaaaccgaaggcgaaccggtgatattgcgccgggcgaaagcaacagcgtatatccttgaacatgttgaaatttcgattcgtgatgaagaactgattgccggtaaccgcaccgtaaaaccgcgcgccgggattatgtcgccggaaatggacccttactggctgctgaaagagctggatcaattcccgacgcgtccgcaggaccgctttgctatcagcgaagaagataaacgtatctaccgtgaagagttgttcccgtactgggaaaaacgttcgatgaaagatttcatcaacgggcagatgacagatgaagtaaaagccgcgaccaacacgcagattttcagcatcaaccagacggataaaggccaggggcacattattattgattacccacgcctgttgaatcacgggctgggtgagctggtggcacagatgcagcaacattgtcagcaacagccggagaatcacttttatcaggccgcgttgttactgctggaagcctcgcagaaacacattttgcgttacgccgaactggcggaaacgatggcggcaaactgcacagatgcccagcgtcgcgaagagctgctgactattgcagagatctcccgccataacgcgcaacataagccgcagacgttctggcaggcgtgccagttattctggtacatgaacatcattctgcaatacgaatccaacgccagttcgctatcgttggggcgcttcgaccagtatatgttgccgttctatcagacatcattaacccagggcgaagatgcggcgttcctgaaagaactgctcgaatctttatgggtgaaatgcaacgacatcgtgctgttgcgctccaccagtagcgcgcgttatttcgccggtttcccgaccggctataccgcactgctcggcgggttaaccgagaacggacgtagcgcggtgaacgtgctttcgttcctttgccttgacgcctatcaaagcgtgcaattaccgcaaccgaacctcggcgtgcgcactaacgccttgatcgacacgccgttcctgatgaaaaccgccgaaaccattcgcttcggtaccggtattccgcaaatctttaacgatgaagtggtggtgccagcgttcctcaaccgtggcgtttcgctggaagatgcgcgcgactattccgtagtgggctgtgtggaattatctattcccggcagaacctacggcttgcatgacatcgcgatgtttaatctgctgaaagtgatggaaatctgcctgcatgaaaatgaaggcaatgctgcgctgacttatgaaggtttactggagcagatccgcgccaagatcagccactacatcaccctgatggttgagggcagcaatatttgtgatatcggccatcgcgactgggcacctgtaccgctgctctcatcgtttatcagcgattgtctggaaaaaggccgcgatattaccgatggcggcgcgcgttataacttctccggcgtacaggggatcggtatcgccaacctgagcgattctctccatgcgttgaaagggatggtttttgagcaacagcgtttaagttttgacgaattgctgtcggtattaaaagccaacttcgcaacgccagaaggcgaaaaagtccgcgctcgcttaattaaccgcttcgagaaatacggtaacgatatcgacgaggtggataacatcagcgccgaactgttgcgccactactgcaaagaagtggaaaaataccagaacccgcgcggcggctacttcacgccgggatcgtataccgtttctgctcacgtcccgttgggatcggtggttggcgcgacgccagacggtcgttttgccggagaacagctggcagacggcggcttgtcacccatgctgggccaggacgcacaagggccaacagcggtactgaagtcagtcagtaagctcgataacacgctgctgtctaacggtacgttgctgaacgtgaaattcactccggcgaccctggaaggtgaagcaggattacgcaaactggccgacttcttacgggcgtttacccagcttaagttacaacatattcagtttaacgtggtgaacgccgacacgttgcgggaagcgcaacagcgcccacaagattatgccgggctggtggtgcgcgttgccggatacagcgccttctttgtcgaactgtcgaaggagatccaggatgacatcatccgccggacagcgcatcagctgtaacgttgtggaaacgcgccgcgatgatgtggcgcgcattttcaacattcagcgttattcactgaatgacggcgagggcattcgtacggtggtcttttttaaaggctgtccgcatctttgcccgtggtgtgctaatccggagtcgatctccggcaaaatccagacggtacgcagagaggcgaaatgtctgcactgtgcgaaatgtttgcgtgatgcggatgaatgcccctccggggcgtttgaacggattggtcgcgatatcagccttgacgctctggaacgggaagtgatgaaagatgacattttctttcgcacgtccggcggcggcgtcacgctttctggcggcgaagtgttaatgcaggcggagtttgctacccgttttttacagcgactgcggctgtggggtgtgtcatgcgccattgaaactgccggagacgcaccagccagcaagctattaccgctggcgaaattgtgcgatgaagtgttgttcgatttaaaaattatggacgcgactcaggcgcgggatgtggtgaagatgaacctgccacgcgtgctggagaatctgcgtttgctggtgagtgagggcgtcaacgtgatcccgcgtttaccgctgatccctggtttcacgctcagccgggagaatatgcagcaggcgctggatgtactgatcccgctgaatatcaggcagatccatctgttaccgtttcatcagtacggcgaaccgaaataccgcctgctggggaaaacatggtcgatgaaagaggtgcctgcgccgtcgtcagctgatgtggcaacgatgcgcgaaatggcagaacgggccggacttcaggttaccgtgggaggttaaaatggcatacctggtggcagtaaccgcctgcgtaagcggcgtggcgcatacttatatggcggcggaacggctggaaaagttgtgcctgttagagaagtggggagtcagcattgaaactcagggcgcgctgggaacggagaatcgtttagcggatgaggatatccgccgggcggatgttgctctgttgattacggatatcgagcttgccggtgccgagcgatttgaacattgccgctatgtgcaatgcagcatctacgcattcctgcgtgagccgcagcgggtaatgagcgcggtgcgcaaagtgctttctgcgccgcagcaaacccatcttattctggagtagtcggtttttctgtcagttggctgtggtactgccggcgatattccgacggcgagcgttcggtgtttttacgaaacagacggcagaagtagttgctgtcgacaaagccgcaggcgtgcgccacttcttttaccttcaggtcatagcctttcaataacgtcttagcgtgctccagtcgcgtgtgattcaggtattcgttaaaaccaatggcccccgttttttgaaacaggtgcgagaggtaatttggcgaaatataaaacgcctgtgcaacagattcgcgggtaagcgcggaggcatagcgttcgtcgatataatcgcgaatagcttcaaatagtgcctggctgcgtgaggcggtctggatttggctgccaagcaaatcgcggcagtggctaagcaggctggcgacgataagccttgccgtttgctgctcctgcggctgcatttgcatttcattgagcgtttgtagcagaaaagaacctatgcgtgggccgcgtcgggcgacgtgttgcttcgccagattttgatattgtttgccatcccattgcacgacgctgaagccgagttgctgtttgccaaacagcacgctaaaggtagtagcgggggcttgccattgtggaaaattccagccaccagcaggaacgtacagcacatcgccgggaactaacgttgctccagcgccggtatcaacaaactcaccttccagcacaatttccagccgtggaaaatcgacctgatacgcaagatcgggcaccgggccgttactgctggcaaagtaaatctggcgcagggacagcgggccgttgatcaggcgggagagcagatagctgacgtcgtgatacatgttattcccttaggtatgtagacgggaaaacagtaactggcattattaaaaaaggccacctgaaaagtgtggcctgaggggagttcgatgtaaacattgcggcagttgtattgccggatgtggcgtaaacgccttatccagcctaccgccgcgatctgtaggccggataagacgcgtcaagcgtcgcatccggcaaatagcgcctggctgataattactgattacccacctgatcgccatagggcagtgtgtcgtaatcgatcagtgcgtttttcttatacgggttaccaatccagcgggtagtttctttgaactgcggattcaccactgaacgggttggatcgtaaccgtcgtaagataagcccgccaaatctgaccaggtgtggatcagttccgccaggctgtatttacgatcaacatcctgcgagaaatcacggggatgagtcgcttgccatttttctgacgtccacagcaggaacggaatggtgtacatatgacgcgtcgggttgtcctcattacgcccctgagttttgtgcggcggcgtgtcgtaaacctcttcaccgtggtcagagaaataaaccaggaaaccgttcgggtttgctgctttaaagtctttaatcaggctggcaaccacatgatcgttatacaggttagcgttgtcataatcgttatatgactccagctcttccgcgtttaatcccggcggaacatgatcggtattgccatcaaacttgccctgattttccgggtagcggtatttgtatttgatatgcgtacccagcagatgaacaatgatcagtttcttcggcgcagggtcattcagcacttcctggaacggcttcagcacgttggtgtcgtattcacgcgcactctgcgtacgttgctggttcatgtagtactgcttgtcggtctggcgcgaaaataccgtcagcatggtattgcgggcggtcatcgtctgctggttggtgatccagaaggttttataacccgcctgtttcatcatgttcatcagcgacggctgcgtcagatacagatccgggttcttttcattggcaaaggtcagcgcctgttgcaggatttcaatggtgtacggacgagacgtaactacgttattaaacacggtcagattcggatcggttttatgcagcgcatccagctccggcgtggtttcacgcggataaccgtacagactcatgcgtccgcgctgggtcgactcgccaatcaccagcactaaagtgcgcggttcgttacccgattcatctttgaaattagccagtggcggcaaggcattattttcattcagtaactttgttagcgagtttagttgctgacgatactgataatagccggtcaggaattgccacggtgcggcaggctccatacgcgaggccaggttatccaacgttttctcaaacggcttgtttttgataaacgtattcatggcgatcggatgcagaatcaagccataaagcagggcaaaagagacaacataacgccacggctttggaatatagaccgggcgcaggcgtgtccacagcagaactgccaccgccgtataggccagcgcgataagcacaattttcaggctgaaatactggcttaaatactcgctggcttcgttggtgttggtttcgaacatcacaaacagaacgctctgcgagaactcctgaccgtagatgacgtagtagcacagcgccgccagagaggccgcccatagcaccacgccgattactgcggcaataattttaatccgcttcggaaagaggaataccgggatcaaccacagcgaactgaataacagcgagtcgcgaatgccgttagtgccactataaccactgatgtaaataatggcctgtagcagagtagagaaaaaccaaaagtagagcagtgcccaacccagggctttccagctaaaaagaggtttagcctggacttctgtggaatgcatagtaagaacctgtcttgaaaaaatatcgccgaatgtaacgacaattccttaaggatatctgaaggtatattcagaatttgaataaaatgcagacagaaatatattgaaaacgagggtgttagaacagaagtatttcagaaaaccctcgcgcaaaagcacgagggtttgcagaagaggaagattagccggtattacgcatacctgccgcaatcccggcaatagtgaccattaacgcttgttcgacgcgaggatccggttcctggccttctttttctgcctggcgggagcggtgcagcaactcggcctgcaatacgttcagcgggtcggtgtaaatattccgtagctgaatagactctgcaatccacggcagatcggccatcagatgggaatcgttggcaatcgccagcaccactttgatgtcttcttcttgcaggttgcgtaactctttacctaacggccacagtgctttgtctaccaggcgttggtcatagtattccgccagccacaggtctgctttggcgaagaccatctccagcatgccgagacgcgtcgagaagaatggccaatcgcggcacatagcctccagctcgctctgtttgccgtcttcgaccactttttgcagcgccgtacctgcacccagccaggcggggagcatcagacggttttgcgtccaggcgaagatccacggaatggcgcgtagtgactcgacgccgccggttgggcgacgtttcgccggacgtgaacccaacggcagtttgcccagttcttgttccggcgtagcggagcggaagtaaggcacaaaatctttgttttcacgtacgtagccgcggtagacatcgcaggagatgactgacagttcatccataatgcgacgccagctctctttcggctccggcggtggcagcaggttggcttccagaatcgccccggtataaagcgacaggctgctgacggtgatttctggcagaccatatttaaagcggatcatctcgccctgttcggttacgcgcaggccgcctttcaggcttcctggcggttgtgacagcagcgccgcatgagcaggtgcgccgccgcgaccaatggaaccgccgcgaccgtggaacaacgtcagctcaatacccgctttttcgcaggttttgattaatgcatcctgtgcctgatattgcgcccaggaagctgccatcactcccgcatcttttgctgagtcggaatagccaatcatcaccatctgtttgccctgaatcaggccacgataccagtcaatattgagcagctgggtcatgacatcgttggcgttgttcagatcatcgagggtttcaaacagcggagcaaccggcatcgcaaacccgatacccgcttctttcagcagcaggtggacagccagtacgtcggacggcgttttcgccatcgagatcacgtaggcggcaatggagccttgcggtgcttcggcaatcacctggcaggtatcgagcacttcgcgcgtttcggcgcttggttgccagttgcgcggcagaagcggacgtttggagttcagttcgcggatcaggaacgcctgtttgtcggcctctgaccagctttcgtagtcgccgataccgaggtagcgggtcagctcgcccagcgcttcggtatgacgcgtgctctcctgacggatatcaatacggaccagcggtacgccgaaacatttcacgcggcgcagggtgtcgagcagatcgccgttggcgataatacccatgccacacgcctgaagtgactggtagcaagcgtagagcggttcccacagttcttcgttttgtgtcagcaggccttctggttttggcagttcttcgcctttcaggcgcgcttccagccatgcctgtgtcgccatcaggcgagaacgcaggtttttcatcagatagcgatacggttctgcggcaccttcttcgccaaccagcgccagcagttcaggggtcgcttcaaccatcgacagttcagaaaccagcacctgaatatctttcaggaacaaatcggtggctttccagcggctgagtagcaggacgtggcgggtgatatcggcagtgacgttcgggttgccgtcgcggtcgccgcccatccacgaagtaaaacggaccggaacaaattcgacgggcagtttgtagccgaggttctcttccagttgttcgttcagttcgcgcaggtaatttggtacgccttgccacaggctgttttccactacggcaaagccccatttggcttcatctaccgggcttggacgcagcttacggatttcatcggtatgccatgactgggcgatcaactggcgcaggcgacgcatcagctggttgtgttcgtagtcagcgatatctttgttatcgagctgttttaaacaggcgttcacttccaccattttgtggatcagtgtacgacgggtaatttcggttgggtgagccgtgaggaccagttccagcgacagcgattccactgcttttttgatggtgtcttcgctcagttccggctggtttttcagtttacgcagggtgcgggcgatcacttccgggttgctggcagcttcgcctttcggcgaaatgctgtggtattgctcggcggtgttggccaggttcaggaactgactaaacgcacgcgcaacgggcagcagctcgtcgttcgacaaattttgtaaggtggtgagcaactcctggcggttagcatcattgccagcgcgtgaagatttcgacaacttacggatagtttctacgcgttcaagaatgtgttctcccaacgcatccttgatggtttctcccagcactttgccgagcatactgacattactacgcaatgcggaatattgttcgttcatattaccccagacaccccatcttatcgtttgatagccctgtatccttcacgtcgcattggcgcgaatatgctcgggctttgcttttcgtcgtcttttataaagccacgtaaaagcggtgacgtcaaatgctgcgaaatcgcttcagcaaacgaataaatagcaggaatttacgtcattaaattcacgacgctttaaataagcgtaacttatggaaatgttaaaaaatcgccccaagtaacaccaaaggtgtaggtcggataagatgcgcaagtatcgcatccgacattattgcggcactggagtttggcaacagtgccggatgcggcgcgagcgccttatccggcctacagttgggcatcgtttgagtcactgtcggtcggataagatgcgcaagtatcgcatccgacattattgcggcactggagtttggcaacagtgccggatgcggcgcgagcgccttatccggcctacggttgggcatcgtttgagtcactgtaggtcggataagatgcgcaagcatcgcatccgacattattgcggcactggagtttggcaacagcgccggatgcggcgcgagcgccttatccggcctacgttttaatgccagcaaaaatggtgaattacctgggttatcagttcgcgggtgggcttgataaaccgtgtttccagatattcatcaggttgatgagcctgattaattgagccaggccccaacaccagcgtcgggcataacgtttgaataaacggcgcttcggtacagtagttcaccacttcggtttttgctccgagcaatttctcaaccacttcaaccagttgatgattcggtgggcattcatagccagggatcggcggatgcagctcgtcgaccgtcagacgacccggccagcgttcgctcaccggagccaatgcatcgttgagcaaaccattaagttcattgagtgtcatgccaggcagcggacgaatatccatatgcaactcacagcaagcgcaaatacggttagaagcgtcgccaccgtgaatatgcccgaggttgagcgtagggtatggcacggtaaacgcttcgtagtgataacgttctttcaggttatcgcgcaattgcaaaatatgcccgatggcgtcgtgcattagttcgatagcgttaactccgcgtgctggatcgctggagtgccccgactggccctgaatacggatggcgttagagatatgacctttatgtgcgcgtaccggttgtagtgacgtcggttcgccaatgatggcgcaatccgggcgcagggcggtagtttcggcaaaataacgcgctccggccatactggtttcttcatcagcagtcgccagaatgtagagcggttttttcagtttcgtgacgtcgacatcgcgtagcgcatcaaggataaacgcaaaaaagcctttcatgtcggcggtgcctaagccgtaaagcttgccgtcatgctccgtcagtgtaaacggatcgcgcgtccagcgaccgtcatcaaatggcaccgtatcggtatgccccgccagcaacaagccgccagccccctgtccgatacttgccagcatattgaatttgttgcgagttcctggaacaggctgcacttccacattgaagcccaaatctttaaaccagtccgccagcagagtgattaaatctgcattgctttgatcgagtgcctcttccgtggcgcttattgaaggtgtggcaatcagagcgcggtaaatctcgataaatggcggtaatttgtttttcattgttgacacacctctggtcatgatagtatcaatattcatgcagtatttatgaataaaaatacactaacgttgagcgtaataaaacccaccagccgtaaggtgaatgttttacgtttaacctggcaaccagacataagaaggtgaatagccccgatgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtagtgtttctcgccaccgcccatgaagttagccacgatttagcgccgcagtttcttgaagcgggctgcgtggtgttcgacctttccggcgcgtttcgtgttaacgacgccaccttctatgaaaaatattacggctttacccatcaatacccggaactgttggaacaggcagcctacggtctggcggagtggtgcggtaataaattaaaagaagcgaatttgattgcggtgccgggctgttatccgacggcggcacagctggcgctgaaaccgttgattgatgccgatcttcttgacctcaatcagtggccggtgatcaacgccaccagcggcgtgagcggtgcagggcgtaaagcggccatttcaaacagcttttgtgaagttagcctgcaaccgtatggcgtctttactcatcgccatcaaccagagatcgccacacacctcggtgctgacgttatcttcaccccacatctgggcaatttcccgcgcggcattctcgaaaccattacctgccgcctgaaatcgggtgtgacccaggcgcaagtcgcgcaagtgttacagcaggcgtatgcccataaaccgctggtgcggctgtatgacaaaggcgttccggcgctgaaaaatgtcgttgggctgccattttgcgatatcgggtttgccgttcagggcgagcatctgattattgtggcgaccgaagacaacttactgaaaggcgcggcggcacaagcggtacagtgcgccaatattcgtttcggctatgcggaaacgcagtctcttatttaagggtgcaatgatgaatccattaattatcaaactgggcggcgtactgctggatagtgaagaggcgctggaacgtctgtttagcgcactggtgaattatcgtgagtcacatcagcgtccgctggtgattgtgcacggcggcggttgcgtggtggatgagctgatgaaagggctgaatctgccggtgaaaaagaaaaacggcctgcgggtgacgcctgctgatcagatagacattatcaccggagcactggcgggaacggcaaataaaaccctgttggcatgggcgaagaaacatcagattgcggccgtaggtttgtttctcggtgacggcgacagcgtcaaagtgacccagcttgatgaagagttaggtcatgttggactggcgcagccaggttcgcctaagcttatcaactccttgctggagaacggttatctgccggtggtcagctccattggcgtaacagacgaagggcaactgatgaacgtcaatgccgaccaggcggcaacggcgctggcggcaacgctgggcgcggatctgattttgctctccgacgtcagcggcattctcgacggcaaagggcaacgcattgccgaaatgaccgccgcgaaagcagaacaactgattgagcagggcattattactgacggcatgatagtgaaagtgaacgcggcgctggatgcggcccgcacgctgggccgtccggtagatatcgcctcctggcgtcatgcggagcagcttccggcactgtttaacggtatgccgatgggtacgcggattttagcttaagttttgttggccggaggcgcagctttccggcattgaatttcaaaataaggaaacagagttatggcactttggggcgggcgttttacccaggcagcagatcaacggttcaaacaattcaacgactcactgcgctttgattaccgtctggcggagcaggatattgttggctctgtggcctggtccaaagccctggtcacggtaggcgtgttaaccgcagaagagcaggcgcaactggaagaggcgctgaacgtgttgctggaagatgttcgcgccaggccacaacaaatccttgaaagcgacgccgaagatatccatagctgggtggaaggcaaactgatcgacaaagtgggccagttaggcaaaaagctgcataccgggcgtagccgtaatgatcaggtagcgactgacctgaaactgtggtgcaaagataccgttagcgagttactgacggctaaccggcagctgcaatcggcgctggtggaaaccgcacaaaacaatcaggacgcggtaatgccaggttacactcacctgcaacgcgcccagccggtgacgttcgcgcactggtgcctggcctatgttgagatgctggcgcgtgatgaaagccgtttgcaggatgcgcttaagcgtctggatgtcagcccgctaggctgtggcgcgctggcgggaacggcctatgaaatcgaccgtgaacagttagcaggctggctgggctttgcttcggcgacccgtaacagtctcgacagcgtttctgaccgtgaccatgtgttggaactgctttctgctgccgctatcggcatggtgcatctgtcgcgttttgctgaagatctgattttctttaacaccggcgaagcggggtttgtggagctttctgaccgcgtgacttccggttcatcattaatgccgcagaagaaaaacccggatgcgctggagctgattcgcggtaaatgcggccgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccacgttgccaggaagcggctcagcagggttacgccaacgccaccgaactggcggattatctggtggcgaaaggcgtaccgttccgcgaggcgcaccatattgttggtgaagcggtggtggaagccattcgtcagggcaaaccgctggaagatctgccgctcagtgagttgcagaaattcagtcaggtgattgacgaagatgtctatccgattctgtcgctgcaatcgtgcctcgacaagcgtgcggcaaaaggcggcgtctcaccgcagcaggtggcgcaggcgattgcttttgcgcaggctcggttagggtaagaacatttatatgtataaatttgagcctggcttatcgccgggcttttttatggcaaaaaaaagcggatcctggagatccgcaaaagttcacgttggctttagttattcgagttgagaaactctcgaaacgggcagtgacttcaagggttaaaagaggtgccgctccgtttctgtgagcaattatcagtcagaatgcttgatagggataatcgttcattgctattctacctatcgccatgaactatcgtggcgatggaggatggataatgaatattcgtgatcttgagtacctggtggcattggctgaacaccgccattttcggcgtgcggcagattcctgccacgttagccagccgacgcttagcgggcaaattcgtaagctggaagatgagctgggcgtgatgttgctggagcggaccagccgtaaagtgttgttcacccaggcgggaatgctgctggtggatcaggcgcgtaccgtgctgcgtgaggtgaaagtccttaaagagatggcaagccagcagggcgagacgatgtccggaccgctgcacattggtttgattcccacagttggaccgtacctgctaccgcatattatccctatgctgcaccagacctttccaaagctggaaatgtatctgcatgaagcacagacccaccagttactggcgcaactggacagcggcaaactcgattgcgtgatcctcgcgctggtgaaagagagcgaagcattcattgaagtgccgttgtttgatgagccaatgttgctggctatctatgaagatcacccgtgggcgaaccgcgaatgcgtaccgatggccgatctggcaggggaaaaactgctgatgctggaagatggtcactgtttgcgcgatcaggcaatgggtttctgttttgaagccggggcggatgaagatacacacttccgcgcgaccagcctggaaactctgcgcaacatggtggcggcaggtagcgggatcactttactgccagcgctggctgtgccgccggagcgcaaacgcgatggggttgtttatctgccgtgcattaagccggaaccacgccgcactattggcctggtttatcgtcctggctcaccgctgcgcagccgctatgagcagctggcagaggccatccgcgcaagaatggatggccatttcgataaagttttaaaacaggcggtttaaaccgtttaacgcagctacccgataggcttccgccatcgtcgggtagttaaaggtggtgttgacgaagtactcaatagtgttgccgccacctttctgttccataatcgcctgaccgatatgaataatttcggcagcgcgctcgccaaagcagtgaatacccagaatctcttttgtttcccgatggaacaaaattttcagcgtgcccacgttcatgccgacgatttgtgcgcgtgccagatgtttaaactgggcgcggcccacttcatatggcactttcattgcggtcagctgctgttcggttttgcccacagagctgatttccgggatggtgtaaataccggtagggatatcttcaatcagatgtgcggtggcttcgccttttaccagcgcctgcgcggcaatgcgcccctggtcataggccgccgacgccaggctcggataaccaatcacgtcgcccaccgcgtaaacgtgtggctgtgcggtctgatacatgctgttgaccttcagctgtccgcggctgtcagtttctagcccaatgttctgtaacgccagcgaatcggtattaccggtgcgaccgttggcatagagcaggcagtcagctttcagttttttacccgacttcagatgcatgatcacaccatcgtcacagccttcgatcttctcgtactcttcgttgtgacgaatcactacgccactgttccagaagtgataggagagagaatctgacatctcttgatcgagaaatgccagcaggcgatcgcgggtgttgatcagatccacttttacatccataccgcggaagatcgacgcatattcacagccgatcactccagcaccatagataagtacatggcgcggttcgtggtgcatgctgagaattgagtcgctgtcgtaaatgcgtggatgggtgaaatcaacatctgttggatgatatggacgagagccgcaggcaataacaaatttttcagcggttagtgtttcaacgctgccgtccgggcaatccagcgccaacgtatgctcgtcaacaaagcgagcgtttccctgcaatatttcacagtgattacgttcgtaaaatccctgacgcatgcgcgtttgttgattaatcacgttatcggcatggttaaggatatcggcaaaagaagagcggagcagtcgggaatggtcgctgtaaagtgggttttgattgaattctataatgcggctgacggcgtgacggagagctttcgacgggatggtgccccagtgggtgcaaccgccgccaacattttgataacgctcgataactgcgacgcgcgcaccttgcttaaccaggcccattgcagcgccttcgccgccggggccggaacctattactatggcatcgtaatcgtaggaatgtggcatggtagggcttacctgttcttatacataaaagcaacagaatggtaacattttatcgcgggtaagccaattgatccccgtcatttatctggctatatcctgagcggcctttgctttgtctgtttcttacttttgccctgacgttttattggatttttatcgacgatactctccgtttaagcggcaggtttccgctgtacgtaaaagaaccggccaaagaattgcagtaaatatgttttattgcgttaccgttcattcacaatactggagcaatccagtatgttcattctctggtatagtgccagcagtacttttggcaaggattcagacatcgtgatgggcgtaagagcgcaacaaaaagaaaaaacccgccgttcgctggtggaagccgcatttagccaattaagtgctgaacgcagcttcgccagcctgagtttgcgtgaagtggcgcgtgaagcgggcattgctcccacctctttttatcggcatttccgcgacgtagacgaactgggtctgaccatggttgatgagagcggtttaatgctacgccaactcatgcgccaggcgcgtcagcgtatcgccaaaggcgggagtgtgatccgcacctcggtctccacatttatggagttcatcggtaataatcctaacgccttccggttattattgcgggaacgctccggcacctccgctgcgtttcgtgccgccgttgcgcgtgaaattcagcacttcattgcggaacttgcggactatctggaactcgaaaaccatatgccgcgtgcgtttactgaagcgcaagccgaagcaatggtgacaattgtcttcagtgcgggtgccgaggcgttggacgtcggcgtcgaacaacgtcggcaattagaagagcgactggtactgcaactgcgaatgatttcgaaaggggcttattactggtatcgccgtgaacaagagaaaaccgcaattattccgggaaatgtgaaggacgagtaatgaaacaagcaaatcaagatagaggtacgctgctgctggcgttagttgctggcttatcgattaatggtactttcgcagcgctgtttagctccattgtgccattttctgtattcccgattatttccctggtgctgacggtttactgcctgcatcaacgttatcttaatcgcactatgccggtaggcttgccgggtctggcagctgcctgttttattctcggcgtactgctgtacagcacggtagttcgtgcggaatatccggatatcggctctaacttcttcccggcagtactctccgtcattatggtgttctggattggcgcgaagatgcgtaaccgtaagcaggaagttgctgagtaatcggtattatgccggatgctggcgcatccggcatgggttttacttcgcggtcagtaatacgccgcactccatatggtgcgtgtaggggaactgatcaaacagagccagacgttcgaccttgtgcgtctggcttaatgtttccagattcttgcataacgtttccgggttacaggagatgtacaaaatacgcggatacgcctgcaccattttctcggtttcactgtccagaccgctgcgcggagggtcgacaaaaatggtttcgcactgataactctttaagtcgatcccttgcaggcggttaaactcgcgcacaccattcatcgcctgagtaaattcttctgccgccatacgaataatttgtacgttatcaatatggttagctgcgatgttgtattgcgcagcagcaaccgacggcttagcgatttcggtggctaatacccgatcaaaattacgcgccagcgctaatgaaaagttaccgttgccgcagtacagctccagtaaatcgccttttgagcctttggttacgtccagcgcccattccagcatctgaatattcatcgccgcgttcggctgggtaaagctgttttctacctgacggtagatcatctctttccctgcgaccggcagacgttcatcgatgtaatcctgatccagctcgattttggttttcgttgcccgaccaatcagatgcacattcagattctgcgcgcgcagtgcatcgcgcagggcctccgcttcctgacgccactcatcatccagcttcttatggtatagcagggaaaccaccgcctgattactcagtgtagtgaggtaatcaatctggaacaacttgtggcgcagaacgggattattacgcacacccgcaatcatcgccgtcatcaactggttgataagttcactggcggcggggaagctatccacgcggatgcggcttttggtttgttgatcgaaaatgatgtgatacaggtcatcgccatcgtgccagatgcggaactccgcgcgcatccggtaatgactgaccggcgagcgaaacacttccggaaccaggtcagaaaacggtgccatcatactttgcaaacgtaccactttttcggctaactgcgcttcatactgttctgttggaaggtgttcgggggtcatgatgtatcctgaaaaattaaagtacgcggcgattgtagggattgctcatcagatgtccagatcttgatgaattcctatttgtgagctacgtctggacagtaacttgttacaacctgtagcatccacttgccggtcctgtgagttaatagggaatccagtgcgaatctggagctgacgcgcagcggtaaggaaaggtgcgatgattgcgttatgcggacactgccattcggtgggaagtcatcatctcttagtatcttagatacccctccaagcccgaagacctgccggccaacgtcgcatctggttctcatcatcgcgtaatattgatgaaacctgcggcatccttcttctattgtggatgctttacaatgattaaaaaagcttcgctgctgacggcgtgttccgtcacggcattttccgcttgggcacaggataccagcccggatactctcgtcgttactgctaaccgttttgaacagccgcgcagcactgtgcttgcaccaaccaccgttgtgacccgtcaggatatcgaccgctggcagtcgacctcggtcaatgatgtgctgcgccgtcttccgggcgtcgatatcacccaaaacggcggttcaggtcagctctcatctatttttattcgcggtacaaatgccagtcatgtgttggtgttaattgatggcgtacgcctgaatctggcgggggtgagtggttctgccgaccttagccagttccctattgcgcttgtccagcgtgttgaatatatccgtgggccgcgctccgctgtttatggttccgatgcaataggcggggtggtgaatatcatcacgacgcgcgatgaacccggaacggaaatttcagcagggtggggaagcaatagttatcagaactatgatgtctctacgcagcaacaactgggggataagacacgggtaacgctgttgggcgattatgcccatactcatggttatgatgttgttgcctatggtaataccggaacgcaagcgcagacagataacgatggttttttaagtaaaacgctttatggcgcgctggagcataactttactgatgcctggagcggctttgtgcgcggctatggctatgataaccgtaccaattatgacgcgtattattctcccggttcaccgttgctcgatacccgtaaactctatagccaaagttgggacgccgggctgcgctataacggcgaactgattaaatcacaactcattaccagctatagccatagcaaagattacaactacgatccccattatggtcgttatgattcgtcggcgacgctcgatgagatgaagcaatacaccgtccagtgggcaaacaatgtcatcgttggtcacggtagtattggtgcgggtgtcgactggcagaaacagactacgacgccgggtacaggttatgttgaggatggatatgatcaacgtaataccggcatctatctgaccgggctgcaacaagtcggcgattttacctttgaaggcgcagcacgcagtgacgataactcacagtttggtcgtcatggaacctggcaaaccagcgccggttgggaattcatcgaaggttatcgcttcattgcttcctacgggacatcttataaggcaccaaatctggggcaactgtatggcttctacggaaatccgaatctggacccggagaaaagcaaacagtgggaaggcgcgtttgaaggcttaaccgctggggtgaactggcgtatttccggatatcgtaacgatgtcagtgacttgatcgattatgatgatcacaccctgaaatattacaacgaagggaaagcgcggattaagggcgtcgaggcgaccgccaattttgataccggaccactgacgcatactgtgagttatgattatgtcgatgcgcgcaatgcgattaccgacacgccgttgttacgccgtgctaaacagcaggtgaaataccagctcgactggcagttgtatgacttcgactggggtattacttatcagtatttaggcactcgctatgataaggattactcatcttatccttatcaaaccgttaaaatgggcggtgtgagcttgtgggatcttgcggttgcgtatccggtcacctctcacctgacagttcgtggtaaaatagccaacctgttcgacaaagattatgagacagtctatggctaccaaactgcaggacgggaatacaccttgtctggcagctacaccttctgaaccacgtcccaccgtgctggtgtttgactccggcgtcggtgggttgtcggtctatgacgagatccggcatctcttaccggatctccattacatttatgctttcgataacgtcgctttcccgtatggcgaaaaaagcgaagcgtttattgttgagcgagtggtggcaattgtcaccgcggtgcaagaacgttatccccttgcgctggctgtggtcgcttgcaacactgccagtaccgtttcacttcctgcattacgcgaaaagttcgacttcccggttgttggtgtcgtgccggcgattaaacctgctgcacgtctgacggcaaatggcattgtcggattactggcaacccgcggaacagttaaacgttcttatactcatgagctgatcgcgcgtttcgctaatgaatgccagatagaaatgctgggctcggcagagatggttgagttggctgaagcgaagctacatggcgaagatgtttctctggatgcactaaaacgtatcctacgcccgtggttaagaatgaaagagccgccagataccgttgtattgggttgcacccatttccctctactacaagaagaactgttacaagtgctgccagagggaacccggctggtggattctggcgcagcgattgctcgccgaacggcctggttgttagaacatgaagccccggatgcaaaatctgccgatgcgaatattgccttttgtatggcaatgacgccaggagctgaacaattattgcccgttttacagcgttacggcttcgaaacgctcgaaaaactggcagttttaggctgatttggttgaatgttgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaggcgtattatgcacaccccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcgtcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgtagtgctcacacagattgtctgatagaaagtgaaaagcaaggcgtttacgcgttgggagtgaggctgaagagaataaggccgttcgctttctattaatgaaagctcaccctacacgaaaatatcacgcaacgcgtgataagcaattttcgtgtccccttcgtctagaggcccaggacaccgccctttcacggcggtaacaggggttcgaatcccctaggggacgccacttgctggtttgtgagtgaaagtcgccgaccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaggtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgaccctttaagggtcctgaaggaacgttgaagacgacgacgttgataggccgggtgtgtaagcgcagcgatgcgttgagctaaccggtactaatgaaccgtgaggcttaaccttacaacgccgaagctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttcctgtcgtcatatctacaagccatccccccacagatacggtaaactagcctcgtttttgcatcaggaaagcagctatgaaccactccttaaaaccctggaacacatttggcattgatcataatgctcagcacattgtatgtgccgaagacgaacaacaattactcaatgcctggcagtatgcaaccgcagaaggacaacccgttcttattctgggtgaaggaagtaatgtactttttctggaggactatcgcggcacggtgatcatcaaccggatcaaaggtatcgaaattcatgatgaacctgatgcgtggtatttacatgtaggagccggagaaaactggcatcgtctggtaaaatacactttgcaggaaggtatgcctggtctggaaaatctggcattaattcctggttgtgtcggctcatcacctatccagaatattggtgcttatggcgtagaattacagcgagtttgcgcttatgttgattctgttgaactggcgacaggcaagcaagtgcgcttaactgccaaagagtgccgttttggctatcgcgacagtatttttaaacatgaataccaggaccgcttcgctattgtagccgtaggtctgcgtctgccaaaagagtggcaacctgtactaacgtatggtgacttaactcgtctggatcctacaacagtaacgccacagcaagtatttaatgcggtgtgtcatatgcgcaccaccaaactccctgatccaaaagtgaatggcaatgccggtagtttcttcaaaaaccctgttgtatctgccgaaacggctaaagcattactgtcacaatttccaacagcaccaaattacccccaggcggatggttcagtaaaactggcagcaggttggcttatcgatcagtgccagctaaaagggatgcaaataggtggggctgcggtgcaccgtcaacaggcgttagttctcattaatgaagacaatgcaaaaagcgaagatgttgtacagctggcgcatcatgtaagacagaaagttggtgaaaaatttaatgtctggcttgagcctgaagtccgctttattggtgcatcaggtgaagtgagcgcagtggagacaatttcatgaaggataacaccgtgccactgaaattgattgccctgttagcgaacggtgaatttcactctggcgagcagttgggtgaaacgctgggaatgagccgggcggctattaataaacacattcagacactgcgtgactggggcgttgatgtctttaccgttccgggtaaaggatacagcctgcctgagcctatccagttacttaatgctaaacagatattgggtcagctggatggcggtagtgtagccgtgctgccagtgattgactccacgaatcagtaccttcttgatcgtatcggagagcttaaatcgggcgatgcttgcattgcagaataccagcaggctggccgtggtcgccggggtcggaaatggttttcgccttttggcgcaaacttatatttgtcgatgttctggcgtctggaacaaggcccggcggcggcgattggtttaagtctggttatcggtatcgtgatggcggaagtattacgcaagctgggtgcagataaagttcgtgttaaatggcctaatgacctctatctgcaggatcgcaagctggcaggcattctggtggagctgactggcaaaactggcgatgcggcgcaaatagtcattggagccgggatcaacatggcaatgcgccgtgttgaagagagtgtcgttaatcaggggtggatcacgctgcaggaagcggggatcaatctcgatcgtaatacgttggcggccatgctaatacgtgaattacgtgctgcgttggaactcttcgaacaagaaggattggcaccttatctgtcgcgctgggaaaagctggataattttattaatcgcccagtgaaacttatcattggtgataaagaaatatttggcatttcacgcggaatagacaaacagggggctttattacttgagcaggatggaataataaaaccctggatgggcggtgaaatatccctgcgtagtgcagaaaaataagaaaggggagtattcgctcccctgcaaattatttgcgtagtctgacctcttctaccgcatgattagcacttttcgtcaggattaaactggcgcgctcacgagtaggtagaatattttgctttaagttcagccagttgatctctttccacaatgtcatggcagtcttaatcgcttcttctttagttaatttcgcgtagttatgaaaataggaatccgggtcggtaaaagccccttcgcggaatttcagaaaacggttgatataccatgtctgaagtaagtcttccggtgcatcaacatatatcgaaaaatcgacaaaatcagaaacaaatacatgatgtggatcgtgtggataatccatcccgctctgtaagacatttaacccttcaagaattaaaatatcaggctgaacaaccgttttatctccatccgggatcacatcataaataagatgtgagtaaacaggtgctgtaacgtttggcacgccggatttgagatcggaaacaaacttcaccaggcgatgcatatcatacgattccgggaagcctttcttcttcatcagaccacgttctttcagaacctgattagggtgaaggaagccatctgtagtgatcagttcaacacgacgatgttccggccaacggcttaatagcgcctgcaatacacgggcggttgtacttttccccaccgcgacactgccagcaatactgataatgtaaggaatgcgttgcccgttggtaccaagaaactgttccagaactgcctgacggcgcagattcgagcttatatagaagttcagcaaacgtgacaaaggtaaatagatctcggcaacttcttctaacgagagatcttcattaatacctttgagacgggcgatctcatcttccgataacgtcataggtacggaatcacgcagagctgcccactggttgcggtcaaactgtaggtaaggcgtcattaacgtttgctcttttatactcataagcatgtttctggcggtcatagctctatcggcaaagcgatatttgccatggcgcgtcacagttctgttgaatgggttaatgggcaggagggtaacaccagatggggaggaataataagaaaaaatctctgccaggaagctatcgttgaaaagcaatgtgacagatattccatctgataaaaagaattatggtttagcaggagcgcattgttgagcacaatgatgttgaaaaagtgtgctaatctgccctccgttcggctgtttcttcatcgtgtcgcataaaatgtgaccaataaaacaaattatgcaattttttagttgcatgaactcgcatgtctccatagaatgcgcgctacttgatgccgacttagctcagtaggtagagcaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccaatttcggccacgcgatggcgtagcccgagacgataagttcgcttaccggctcgaataaagagagcttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctcctccctgttttttccttctgtttattgcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcacacgtagactgcccggggcacgccgactatgttaaaaacatgatcaccggtgctgcgcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgtagcaaaagttctgagctaattgccgataacatttgacgcaatgcgcactaaaagggcatcatttgatgccctttttgcacgctttcgtaccagaacctggctcatcagtgattttctttgtcataatcattgctgagacaggctctgttgagggcgtataatccgaaaagctaatacgcgtttcgatttggtttgcctcgcgatcgcggggtgaaaatgtttgtagaaaacttctgacaggttggtttatgagtgcgaataccgaagctcaaggaagcgggcgcggcctggaagcgatgaagtgggtcgttgtggtggcattgctcctggtggcgattgtcggcaactatctttatcgcgacattatgctgccgctgcgtgcgctggccgtagtaattctgattgctgcagcgggtggtgtcgcgctgttaacgacaaaaggtaaagctaccgttgcttttgcccgtgaagcgcgtaccgaagtccgtaaggtcatttggccgactcgccaggaaacattgcacaccacgctgattgtggctgcggttaccgcagtaatgtcactgatcctgtggggactggatggtattctggttcgcctggtatcctttatcactggcctgaggttctgagatgtctgaagctcctaaaaagcgctggtacgtcgttcaggcgttttccggttttgaaggccgcgtagcaacgtcgctgcgtgagcatatcaaattacacaacatggaagatttgtttggtgaagtcatggtaccaaccgaagaagtggttgaaatccgtggcggtcagcgtcgcaaaagcgaacgtaaattcttccctggctacgtcctcgttcagatggtgatgaacgacgcgagctggcacctggtgcgcagcgtaccgcgtgtgatgggcttcatcggcggtacttccgatcgtcctgcgccaatcagcgataaagaagtcgatgcgattatgaaccgcctgcagcaggttggtgataagccgcgtccgaaaacgctgtttgaaccgggtgaaatggtccgtgttaatgatggtccgttcgctgacttcaacggtgttgttgaagaagtggattacgagaaatctcgtctgaaagtgtctgtttctatcttcggtcgtgcgaccccggtagagctggacttcagccaggttgaaaaagcctaacccagcgatcaaaaaagcggcgatttaatcgttgcacaaggcgtgagattggaatacaatttcgcgccttttgtttttatgggccttgcccgtaaaacgattttttatatcacggggagcctctcagaggcgttattacccaacttgaggaatttataatggctaagaaagtacaagcctatgtcaagctgcaggttgcagctggtatggctaacccgagtccgccagtaggtccggctctgggtcagcagggcgtaaacatcatggaattctgcaaagcgttcaacgcaaaaactgattccatcgaaaaaggtctgccgattccggtagtaatcaccgtttacgctgaccgttctttcactttcgttaccaagaccccgccggcagcagttctgctgaaaaaagcggctggtatcaagtctggttccggtaagccgaacaaagacaaagtgggtaaaatttcccgcgctcagctgcaggaaatcgcgcagaccaaagctgccgacatgactggtgccgacattgaagcgatgactcgctccatcgaaggtactgcacgttccatgggcctggtagtggaggactaagaaatggctaaactgaccaagcgcatgcgtgttatccgcgagaaagttgatgcaaccaaacagtacgacatcaacgaagctatcgcactgctgaaagagctggcgactgctaaattcgtagaaagcgtggacgtagctgttaacctcggcatcgacgctcgtaaatctgaccagaacgtacgtggtgcaactgtactgccgcacggtactggccgttccgttcgcgtagccgtatttacccaaggtgcaaacgctgaagctgctaaagctgcaggcgcagaactggtaggtatggaagatctggctgaccagatcaagaaaggcgaaatgaactttgacgttgttattgcttctccggatgcaatgcgcgttgttggccagctgggccaggttctgggtccgcgcggcctgatgccaaacccgaaagtgggtactgtaacaccgaacgttgctgaagcggttaaaaacgctaaagctggccaggttcgttaccgtaacgacaaaaacggcatcatccacaccaccatcggtaaagtggactttgacgctgacaaactgaaagaaaacctggaagctctgctggttgcgctgaaaaaagcaaaaccgactcaggcgaaaggcgtgtacatcaagaaagttagcatctccaccaccatgggtgcaggtgttgcagttgaccaggctggcctgagcgcttctgtaaactaatgcctttacgtgggcggtgattttgtctacaatcttacccccacgtataatgcttaatgcagacgtatatccgagatattcgggttgtggcaaggcggcaactgagtgagtcgccaggagcatagctaactatgtgactggtgcgaatgaaggaagccaacgccgtcacaagctgaatagcgacggatagaaaagatttgttcgttggagcctggcctatccaggcctccgtcgaagaccgcaggagtttcgcaagaaacttaatcccctgcgtagacggtgacagaacgctaagattattcttttatattctggcttgtttctgctcaccgtaattaagacgctctctccgtttggaggagtgaagtgagttccagagattttctctggcaaacatccaggagcaaagctaatggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgcgaagctggcgtatacatgcgtgttgttcgtaacaccctgctgcgccgtgctgttgaaggtactccgttcgagtgcctgaaagacgcgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtctcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaatcgcagttatctttttaacgcattcgcttacgtataaacttattctgatattcaggaacaatttaaatgtctatcactaaagatcaaatcattgaagcagttgcagctatgtctgtaatggacgttgtagaactgatctctgcaatggaagaaaaattcggtgtttccgctgctgctgctgtagctgtagctgctggcccggttgaagctgctgaagaaaaaactgaattcgacgtaattctgaaagctgctggcgctaacaaagttgctgttatcaaagcagtacgtggcgcaactggcctgggtctgaaagaagctaaagacctggtagaatctgcaccggctgctctgaaagaaggcgtgagcaaagacgacgcagaagcactgaaaaaagctctggaagaagctggcgctgaagttgaagttaaataagccaacccttccggttgcagcctgagaaatcaggctgatggctggtgactttttagtcaccagcctttttgcgctgtaaggcgccagtagcgtttcacactgtttgactactgctgtgcctttcaatgcttgtttctatcgacgacttaatatactgcgacaggacgtccgttctgtgtaaatcgcaatgaaatggtttaagcgtgatagcaacaggcattgcggaaagtgttccattttccggtcaacaaaatagtgttgcacaaactgtccgctcaatggacagatgggtcgacttgtcagcgagctgaggaaccctatggtttactcctataccgagaaaaaacgtattcgtaaggattttggtaaacgtccacaagttctggatgtaccttatctcctttctatccagcttgactcgtttcagaaatttatcgagcaagatcctgaagggcagtatggtctggaagctgctttccgttccgtattcccgattcagagctacagcggtaattccgagctgcaatacgtcagctaccgccttggcgaaccggtgtttgacgtccaggaatgtcaaatccgtggcgtgacctattccgcaccgctgcgcgttaaactgcgtctggtgatctatgagcgcgaagcgccggaaggcaccgtaaaagacattaaagaacaagaagtctacatgggcgaaattccgctcatgacagacaacggtacctttgttatcaacggtactgagcgtgttatcgtttcccagctgcaccgtagtccgggcgtcttctttgactccgacaaaggtaaaacccactcttcgggtaaagtgctgtataacgcgcgtatcatcccttaccgtggttcctggctggacttcgaattcgatccgaaggacaacctgttcgtacgtatcgaccgtcgccgtaaactgcctgcgaccatcattctgcgcgccctgaactacaccacagagcagatcctcgacctgttctttgaaaaagttatctttgaaatccgtgataacaagctgcagatggaactggtgccggaacgcctgcgtggtgaaaccgcatcttttgacatcgaagctaacggtaaagtgtacgtagaaaaaggccgccgtatcactgcgcgccacattcgccagctggaaaaagacgacgtcaaactgatcgaagtcccggttgagtacatcgcaggtaaagtggttgctaaagactatattgatgagtctaccggcgagctgatctgcgcagcgaacatggagctgagcctggatctgctggctaagctgagccagtctggtcacaagcgtatcgaaacgctgttcaccaacgatctggatcacggcccatatatctctgaaaccttacgtgtcgacccaactaacgaccgtctgagcgcactggtagaaatctaccgcatgatgcgccctggcgagccgccgactcgtgaagcagctgaaagcctgttcgagaacctgttcttctccgaagaccgttatgacttgtctgcggttggtcgtatgaagttcaaccgttctctgctgcgcgaagaaatcgaaggttccggtatcctgagcaaagacgacatcattgatgttatgaaaaagctcatcgatatccgtaacggtaaaggcgaagtcgatgatatcgaccacctcggcaaccgtcgtatccgttccgttggcgaaatggcggaaaaccagttccgcgttggcctggtacgtgtagagcgtgcggtgaaagagcgtctgtctctgggcgatctggataccctgatgccacaggatatgatcaacgccaagccgatttccgcagcagtgaaagagttcttcggttccagccagctgtctcagtttatggaccagaacaacccgctgtctgagattacgcacaaacgtcgtatctccgcactcggcccaggcggtctgacccgtgaacgtgcaggcttcgaagttcgagacgtacacccgactcactacggtcgcgtatgtccaatcgaaacccctgaaggtccgaacatcggtctgatcaactctctgtccgtgtacgcacagactaacgaatacggcttccttgagactccgtatcgtaaagtgaccgacggtgttgtaactgacgaaattcactacctgtctgctatcgaagaaggcaactacgttatcgcccaggcgaactccaacttggatgaagaaggccacttcgtagaagacctggtaacttgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggccgttccgactctgcgcgctgataagccgctggttggtactggtatggaacgtgctgttgccgttgactccggtgtaactgcggtagctaaacgtggtggtgtcgttcagtacgtggatgcttcccgtatcgttatcaaagttaacgaagacgagatgtatccgggtgaagcaggtatcgacatctacaacctgaccaaatacacccgttctaaccagaacacctgtatcaaccagatgccgtgtgtgtctctgggtgaaccggttgaacgtggcgacgtgctggcagacggtccgtccaccgacctcggtgaactggcgcttggtcagaacatgcgcgtagcgttcatgccgtggaatggttacaacttcgaagactccatcctcgtatccgagcgtgttgttcaggaagaccgtttcaccaccatccacattcaggaactggcgtgtgtgtcccgtgacaccaagctgggtccggaagagatcaccgctgacatcccgaacgtgggtgaagctgcgctctccaaactggatgaatccggtatcgtttacattggtgcggaagtgaccggtggcgacattctggttggtaaggtaacgccgaaaggtgaaactcagctgaccccagaagaaaaactgctgcgtgcgatcttcggtgagaaagcctctgacgttaaagactcttctctgcgcgtaccaaacggtgtatccggtacggttatcgacgttcaggtctttactcgcgatggcgtagaaaaagacaaacgtgcgctggaaatcgaagaaatgcagctcaaacaggcgaagaaagacctgtctgaagaactgcagatcctcgaagcgggtctgttcagccgtatccgtgctgtgctggtagccggtggcgttgaagctgagaagctcgacaaactgccgcgcgatcgctggctggagctgggcctgacagacgaagagaaacaaaatcagctggaacagctggctgagcagtatgacgaactgaaacacgagttcgagaagaaactcgaagcgaaacgccgcaaaatcacccagggcgacgatctggcaccgggcgtgctgaagattgttaaggtatatctggcggttaaacgccgtatccagcctggtgacaagatggcaggtcgtcacggtaacaagggtgtaatttctaagatcaacccgatcgaagatatgccttacgatgaaaacggtacgccggtagacatcgtactgaacccgctgggcgtaccgtctcgtatgaacatcggtcagatcctcgaaacccacctgggtatggctgcgaaaggtatcggcgacaagatcaacgccatgctgaaacagcagcaagaagtcgcgaaactgcgcgaattcatccagcgtgcgtacgatctgggcgctgacgttcgtcagaaagttgacctgagtaccttcagcgatgaagaagttatgcgtctggctgaaaacctgcgcaaaggtatgccaatcgcaacgccggtgttcgacggtgcgaaagaagcagaaattaaagagctgctgaaacttggcgacctgccgacttccggtcagatccgcctgtacgatggtcgcactggtgaacagttcgagcgtccggtaaccgttggttacatgtacatgctgaaactgaaccacctggtcgacgacaagatgcacgcgcgttccaccggttcttacagcctggttactcagcagccgctgggtggtaaggcacagttcggtggtcagcgtttcggggagatggaagtgtgggcgctggaagcatacggcgcagcatacaccctgcaggaaatgctcaccgttaagtctgatgacgtgaacggtcgtaccaagatgtataaaaacatcgtggacggcaaccatcagatggagccgggcatgccagaatccttcaacgtattgttgaaagagattcgttcgctgggtatcaacatcgaactggaagacgagtaattctcgctcaaacaggtcactgctgtcgggttaaaacccggcagcggattgtgctaactccgacgggagcaaatccgtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaaccagaacgtgacggccttttctgcgcccgtatctttgggccggtaaaagattacgagtgcctgtgcggtaagtacaagcgcctgaaacaccgtggcgtcatctgtgagaagtgcggcgttgaagtgacccagactaaagtacgccgtgagcgtatgggccacatcgaactggcttccccgactgcgcacatctggttcctgaaatcgctgccgtcccgtatcggtctgctgctcgatatgccgctgcgcgatatcgaacgcgtactgtactttgaatcctatgtggttatcgaaggcggtatgaccaacctggaacgtcagcagatcctgactgaagagcagtatctggacgcgctggaagagttcggtgacgaattcgacgcgaagatgggggcggaagcaatccaggctctgctgaagagcatggatctggagcaagagtgcgaacagctgcgtgaagagctgaacgaaaccaactccgaaaccaagcgtaaaaagctgaccaagcgtatcaaactgctggaagcgttcgttcagtctggtaacaaaccagagtggatgatcctgaccgttctgccggtactgccgccagatctgcgtccgctggttccgctggatggtggtcgtttcgcgacttctgacctgaacgatctgtatcgtcgcgtcattaaccgtaacaaccgtctgaaacgtctgctggatctggctgcgccggacatcatcgtacgtaacgaaaaacgtatgctgcaggaagcggtagacgccctgctggataacggtcgtcgcggtcgtgcgatcaccggttctaacaagcgtcctctgaaatctttggccgacatgatcaaaggtaaacagggtcgtttccgtcagaacctgctcggtaagcgtgttgactactccggtcgttctgtaatcaccgtaggtccatacctgcgtctgcatcagtgcggtctgccgaagaaaatggcactggagctgttcaaaccgttcatctacggcaagctggaactgcgtggtcttgctaccaccattaaagctgcgaagaaaatggttgagcgcgaagaagctgtcgtttgggatatcctggacgaagttatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagctggaagcgcgtgcgctgatgatgtctaccaacaacatcctgtccccggcgaacggcgaaccaatcatcgttccgtctcaggacgttgtactgggtctgtactacatgacccgtgactgtgttaacgccaaaggcgaaggcatggtgctgactggcccgaaagaagcagaacgtctgtatcgctctggtctggcttctctgcatgcgcgcgttaaagtgcgtatcaccgagtatgaaaaagatgctaacggtgaattagtagcgaaaaccagcctgaaagacacgactgttggccgtgccattctgtggatgattgtaccgaaaggtctgccttactccatcgtcaaccaggcgctgggtaaaaaagcaatctccaaaatgctgaacacctgctaccgcattctcggtctgaaaccgaccgttatttttgcggaccagatcatgtacaccggcttcgcctatgcagcgcgttctggtgcatctgttggtatcgatgacatggtcatcccggagaagaaacacgaaatcatctccgaggcagaagcagaagttgctgaaattcaggagcagttccagtctggtctggtaactgcgggcgaacgctacaacaaagttatcgatatctgggctgcggcgaacgatcgtgtatccaaagcgatgatggataacctgcaaactgaaaccgtgattaaccgtgacggtcaggaagagaagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgctcgtaaaggtctggcggataccgcactgaaaactgcgaactccggttacctgactcgtcgtctggttgacgtggcgcaggacctggtggttaccgaagacgattgtggtacccatgaaggtatcatgatgactccggttatcgagggtggtgacgttaaagagccgctgcgcgatcgcgtactgggtcgtgtaactgctgaagacgttctgaagccgggtactgctgatatcctcgttccgcgcaacacgctgctgcacgaacagtggtgtgacctgctggaagagaactctgtcgacgcggttaaagtacgttctgttgtatcttgtgacaccgactttggtgtatgtgcgcactgctacggtcgtgacctggcgcgtggccacatcatcaacaagggtgaagcaatcggtgttatcgcggcacagtccatcggtgaaccgggtacacagctgaccatgcgtacgttccacatcggtggtgcggcatctcgtgcggctgctgaatccagcatccaagtgaaaaacaaaggtagcatcaagctcagcaacgtgaagtcggttgtgaactccagcggtaaactggttatcacttcccgtaatactgaactgaaactgatcgacgaattcggtcgtactaaagaaagctacaaagtaccttacggtgcggtactggcgaaaggcgatggcgaacaggttgctggcggcgaaaccgttgcaaactgggacccgcacaccatgccggttatcaccgaagtaagcggttttgtacgctttactgacatgatcgacggccagaccattacgcgtcagaccgacgaactgaccggtctgtcttcgctggtggttctggattccgcagaacgtaccgcaggtggtaaagatctgcgtccggcactgaaaatcgttgatgctcagggtaacgacgttctgatcccaggtaccgatatgccagcgcagtacttcctgccgggtaaagcgattgttcagctggaagatggcgtacagatcagctctggtgacaccctggcgcgtattccgcaggaatccggcggtaccaaggacatcaccggtggtctgccgcgcgttgcggacctgttcgaagcacgtcgtccgaaagagccggcaatcctggctgaaatcagcggtatcgtttccttcggtaaagaaaccaaaggtaaacgtcgtctggttatcaccccggtagacggtagcgatccgtacgaagagatgattccgaaatggcgtcagctcaacgtgttcgaaggtgaacgtgtagaacgtggtgacgtaatttccgacggtccggaagcgccgcacgacattctgcgtctgcgtggtgttcatgctgttactcgttacatcgttaacgaagtacaggacgtataccgtctgcagggcgttaagattaacgataaacacatcgaagttatcgttcgtcagatgctgcgtaaagctaccatcgttaacgcgggtagctccgacttcctggaaggcgaacaggttgaatactctcgcgtcaagatcgcaaaccgcgaactggaagcgaacggcaaagtgggtgcaacttactcccgcgatctgctgggtatcaccaaagcgtctctggcaaccgagtccttcatctccgcggcatcgttccaggagaccactcgcgtgctgaccgaagcagccgttgcgggcaaacgcgacgaactgcgcggcctgaaagagaacgttatcgtgggtcgtctgatcccggcaggtaccggttacgcgtaccaccaggatcgtatgcgtcgccgtgctgcgggtgaagctccggctgcaccgcaggtgactgcagaagacgcatctgccagcctggcagaactgctgaacgcaggtctgggcggttctgataacgagtaatcgttaatccgcaaataacgtaaaaacccgcttcggcgggtttttttatggggggagtttagggaaagagcatttgtcagaatatttaaggaatttctgaatactcataatcaatgtagagatgactaatatcctgaaactgactgaactaattgagtcaaactcggcaaggattcgatactattcctgtgtaactttcttaaggaacgagaatgaaacaggaagtggaaaagtggcgaccttttggacatccggatggtgatattcgtgatttatcatttcttgatgctcatcaggctgtctacgttcagcatcatgagggcaaagagcctttagagtatcgcttttgggttacctactctcttcactgcttcacaaaagattatgaacatcagacgaacgaagaaaaacaatcgttaatgtaccacgcgcctaaagaatctcgtcccttctgccagcaccgttataacttagcgcgcacacacttaaaaagaactattttggcgctgccagaaagcaacgttattcatgccgggtatggtagctatgccgtgattgaggtggacttagacggaggagataaggcattttactttgttgcgttcagggctttcagggaaaagaaaaaactccgtttgcatgtaactagcgcttatcccatttctgaaaaacagaaaggtaaatcagtgaaatttttcaccattgcctacaacttattgagaaataagcagcttcctcagccctcaaaataacaaaacccaccttaaggtgggtttcgccagagaattatctctggtattcagaacgccattaccggactttgccttgaccttgcgataatcgcaggttgcgggatgtctgaatttcttcagtctgctgcatcctggaagatgagaacatgtgttcttattttcgtctctatcatagttgagtatttactctcttacaatcagatctctttcattgctcaacaggcgatggcttcagactttgcattacggaatttttaagaaaggcagggcgaaacgaggaagaagcttttcgccctggacaacattcctgctgacggcactaccataaaaaaacacaacgctttcaacaaccttgcgtttttcatcttccgtagcggctcggaataaatttacgttcttacattccgtctcatagtctttgcgaggcgcgtcccagatagctgtcccagtctttccataccggctgcaaaccctgagcggttaacgcggcagcaaccgcttccggtctgcgatcgtcgtgcggtgagaactgttccaactcggggtgattatcggcatagccacctggctgcgttttcgagaaggcgctgacgttattgatcgccagcggaataacgcgatcgcgaaaccacggtgattcccgcgtggagagtgacagttcaatctccggtgcaagcagtcggaaggcgcagatggtttgcactaactggcgttcatccataatcgacgcaggctcaatgccgccagtacacgggcgcaggcgcggaaaggagacagagtaacggctttgccagtaatgctgttgcagccatagcaaatgttcggcaaccatatagctgtcaacgcgccagttgtcggaaaggccaattagcgcgccgaggcctatcttatcaatccccgcacgccccagccgatccggcgtttccagccgccagaagaagtcctgttttttgcctttcagatgatggcgggcataagtcgcctcgtgatatgtctcctgataaaccatcacgccatccagaccaagttgctttaactcggcgtattccgtctccgccagcggttgcacttccatctgtagtgaagagaactgttcacgaagggcagggagatgacgacgaaagtaatccatccccactttcgcctgatgttcaccagtgactaacagcagatgttcaaagcccatctcccgtatagcggcactttccctggcaatatccgcttcatccagcgttttgcgcttgatgcgattactcatggaaaatccacagtacgtgcagtcgttagcgcaaagattggaaagataaagcgggacgtagaaactaactgtgttgccaaatcgctgacgggtcagacgctgcgcccgttgggccagttgttccagatagccactggcggcaggcgataacagcgccatcatgtcgtcgcgggtgagttgcgaggcatttagcgcccgctctacgtcagcagccgttttgccgttgatacgcaggcggatgtcgtcccagtccagttgtcgccagcgatcgctgaaggttttcatgccgatgcctccagaaatccggtcagcgggctggtggcatgagcaaaataactgcggctgcccggtccggactgacgtgccagtaggcctgcttctaccgccagacgaaatgccttcgccatgttgacgggatcgtccgcgacggcaatcgccgtattcactaacaccgcgtcggcccccatttccagcgcctgcgcggcatggctgggaacgccgatgccagcatcgacaaccaccggcactgtggcctgctggataataatctccagcatggcgcgggtttccagtccctgattcgagccaatcggcgcgccgagcggcatcaccgctgcacagccgacttcttccagacgtttacacaataccggatcggccccgcagtaaggcagcacgacaaatccctgttgtaccagcgtttcggcggctttcagggtttcgatgggatcgggcaacagccagcgggcgtcagggtgaatctctaattttaaccagtttgtgcctaacgcttcacgagccagatgggcggcgaaaatggcttcttccgctgttttcgccccggatgtatttggcagcagggtcacacccgccgcgataagcggttcgaggatagcgtcgttgtgctggcgcaagtcgacacgtttcatcgccagtgtcaccagctggctgccggaagcgcggatcgcctccaccatcagttgtgaagaagcgaatttccctgtgccggtaaacagatgtgaatcaaacgttttgtccgcaatacgtaacatttcaaccccctgcaataacctgaaaaagcaggatctggtcgccatcctgcacgatatgttgcgcccactgctcacgcgggacgatttgctgattaatcgccagagccgcgcccgcttgtcgttggtcgagttgctccagtagttcgtgaacagtttgcccggcggcgcactgcatcgcttgatcgttaaacaggatctgcattgcttcctccgcataccgggcaaccactggcgcggcgcaacgccaggctgcgccactggctcgatttaccgtcgaacagtcggagttctcccgcaggtgtctctataccgcttaataacttaatggcttccagtgcctgcaaagtgcccataaccccgaccaccgggccaaccacgcccgccgtgcggcagttgcgttctggctcctggttatctggccacaggcagcggtaacacccctgctcccagggcggcgtcagtaccatcaactgaccgccaaatccgaccgcgctggcggtgataagcggcgtgttgagtgccacgcaggcggcattaatctcctggcgagtcgccatattgtcggtacagtcgagcaccacatcggcccgtgcaaccgcatcttttaacgcctcacccgttaaccgttgttgtaatgctgtcagttgaatgtcgggattcaactgtgtcagtcgctgttggctgacctgcgatttcgggcgatcgatatcttcagtggtaaagaggatttgtcgttgcagattgcttaaatgcacatcgtcgtcatctgccagtaccagcgtcccgacgccagcgcccgccaggtacagcgcagcaggtgtacccagcccgcccagaccgataatcagcacctggctgtcgagcagtttttgctgcccgtccagagcgatatcgtcgagcaggatttggcggctataacgcataaagtcacggtcattcatcgccaactcctgcaatttccagcaactgtgccgttgccaaacgccagtctgcggcttgagtaatggcgctgacgacggcgatactgccgacacccgttgctatcaccgcaggcgcgcgtgccagactgataccgccaatcgccacggtgggataatccgccagtcgctcaacatgccgtgccagctgttccagcccctgcggtgcagaaggcatctgtttggtttgcgtcgggaacacatgtcccagcgcgatataagaggggcgtgctgccagcgcgacgtcgatttccatatcgtcatgtgtcgaaacgcccagccgcaggcctgccgcgcggatggcattgagatcggtggcttgcaaatcttcctgccccaaatggacgccatacgcctgatgcttgatcgccagccgccagtaatcgttgataaacaatcgcgcgttatagcggcggcccagcgcaattgccgccacgacatcggcttccacctcttcatcgcgccgatctttgatgcgtagctggagagtacgtacgcctgcatccaacagacgttcgatccactgtacgctgtccaccaccgggtacagtcctgaacgaaaaggtacaggaggaaaatcaggctgatacatcacgcttcctccttacgcaggtagatttctccgcctctggcacggaagttctccgacatatccgccattcccatttcaatagtttgcgtggcggcgtaatcacgcacttcctggctgattttcatcgagcagaatttcggcccacacatggagcaaaaatgggcgactttacctgactcttgcggcagggtttcatcgtgataagcgcgggcggtaaacgggtcgagggccagattaaactggtcttcccagcgaaattcgaagcgggctttcgacatggcgttatcgcgaatttgcgcgcccggatgccctttcgccaggtcagcggcgtgggcagcaatcttataggtgataagcccctgcttaacatcttctttattgggcagacccagatgctcttttggcgttacgtaacagagcatcgcgcagccaaaccagccaatcatcgccgcaccaatccccgacgtgaagtggtcatagcccggcgcaatatcggtagttagcggccccagagtgtaaaacggcgcttcgtggcagtgctctaactcctcggtcatattgcggcggatcatctgcatcggcacgtggcctgggccttcaatcatcacctgcacgtcatattcccaggcaattttggtcagttcgcccagcgtatgcagctcggcaaactgcgcttcatcgttggcgtcctgaatagaaccggggcgcagaccgtcgcccagcgacagcgaaacgtcataagcggcacagatttcacaaatttcgcggaagtgttgatagaggaaattttcctgatgatgggagaggcaccatttcgccataatcgaaccgccgcgagagacgataccggtcaggcgtttcgcggtcatcggcacatagcgcagcagtacgcccgcatggatagtgaagtaatccacaccttgctcggcctgttccagcagcgtgtcgcggaacgcttcccaggtaagatcttcggcgatcccgttaaccttctccagcgcctggtagatcggcactgtaccgatcggcaccgggctgttacgcaaaatccactcgcgggtttcgtgaatatagcgaccggtggagagatccatcaccgtatccgctccccagcgcgtggaccataccagcttttccacttcttcttcgatggaagaggtgaccgccgagttgccgatattggcgttaacttttaccaggaaattgcgaccaataatcatcggctccgattccggatgattaatgttggccgggataatcgcacgtccggcagcaacttcatcacggacaaattccgcagtgatattttccggcagatgtgcgccaaagctcattcccggatgctggtggcgtaaaacctcgctacggatgcgctcgcggcccatattctcgcggatggcgatgaattccatttccggcgtgatgatgccctggcgggcgtagtgcagttgggtgacacggcgtcctgctttggcgcgttttggtgttagtacgccgctaaaacgcagttcgtcgaggccatcatctgccagccgcgctttagtgtaatcggaactgcgcacggtaagttcttcggtatcgccgcgcgcatcgatccacggctggcgtagttttgccagcccttgctgcacgttaatggcaatctgcggatcaccatacgggccggaggtgtcgtagaccggaatcgcttcgttttcttcgtactgcggctgttctttgctaccgccaattagcgtcgggctaagctggatctcacgcatcggcacgcgcacgccggggtgtgtgccagtgatataaatgcgttttgagttgggaaaggcggtgccttccagggtgtcgataaaatgttgggcccgggcgcgttgttcgcggcgggtcagttttgttgcagacatagctcattccaaaaagttaaggacgtggcttgtcagacgacggatgaagcaagagacgatcgccgcaggggcgatgcgatagcagattaactcttgttcccttcgcaggtattagcctgatcaggttccgcggatcccgaataaacggtctcagccagttaaggcactccgacaagaaattagccccgcaaatggggcattgaatgtaaattacgcgttaacagcgcagaactcaagcaggatgtttgacgcgggcggcgtcaagcaccagcagaatcagcttatcttccagcacaaagcgcgcttccagcgcctcgccgatgtcagataaaacctgttgaaactcaaggtaattatcatgatcgatggcggtttccagactggaatcgtagtaatccataatctgttgagtattggcttcgagttgcggccaaatcttcgcggcgcgcgcgagttgcccgttgccttccagcttatgaagaatgcgctcataaatactgaaatgtccggcagacaagtaatcgaccaggctctgacaaaaatcatcaagggctttttcgtttagcctcatgtacgattctttgccaggcttaatgccaaccagattgtagtaagccacgagcagatgcttacgtacatgtagccagcgatcaaccagtttgttacttcctctgacgcgctccgtcaggttatcgagctggttaagcatgattgactccgcaagtttgtattcaaaaactgctcagtgagaaatgtaaaaaccatgttaaacatgccagtgatgcaaaggtagtgcaagagctatggatcgtataattgaaaaattagatcacggctggtgggtcgtcagccatgaacaaaaattatggttgccgaagggagaattgccatatggcgaagcggcaaatttcgatcttgtgggtcagcgcgcactacaaatcggcgaatggcagggggaacctgtttggttagtacaacagcagcggcgtcacgatatggggtcggtacgtcaggtcattgatctcgatgttgggctgtttcaactggccggacgaggcgtacaactggcggagttttaccgatcgcataaatactgtggttactgcgggcatgaaatgtatccgagcaaaaccgaatgggcgatgctgtgcagccattgccgtgagcgttactacccgcaaatcgccccctgcattattgttgccatccgtcgcgatgattcgatcctcctcgcccagcatacccgccatcgtaacggtgtccatacagtacttgccggattcgtcgaagtgggcgaaaccctcgagcaggcagtcgcgcgggaagtgatggaagagagcggaattaaagttaaaaacttgcgttacgtgacttctcagccgtggccgtttcctcagtctttaatgaccgcgtttatggcggaatatgacagcggcgacatcgtgatcgacccgaaagaattgctcgaggcgaactggtatcgctatgacgatttgccgttactcccgccgcccggcaccgtagcgcgccgtctgatagaagatacggtggcgatgtgtcgggcagagtatgagtgatgatacactgaccgcctgacgcactaaggaacagccaaaatgaccgaacttaaaaacgatcgttatctgcgggcgctgctgcgccagcccgttgatgtcactccagtatggatgatgcgccaggcgggtcgctatctaccggaatataaagccacgcgcgcccaggcaggcgattttatgtcgctgtgcaaaaacgccgagctggcgtgcgaagtgactttgcaaccgctgcgtcgctacccgctggatgcggcgatcctcttttccgatatcctcaccgtgccggacgcgatggggttagggctctattttgaagccggagaaggtccgcgttttacctcgccagtcacctgcaaagctgacgtcgataaactgccaattccggacccggaagatgaactgggttacgtgatgaacgcggtgcgtaccattcgtcgcgaactgaaaggcgaagtgccgctgattggtttttccggcagcccgtggacgctggcgacctacatggtggaaggcggcagcagcaaagccttcaccgtgatcaaaaaaatgatgtatgccgatccgcaggcgctgcacgctctgctcgataaactggcgaaaagcgtcactttgtatctgaatgcgcagattaaagccggtgctcaggcagtgatgattttcgacacctggggcggcgtgcttaccgggcgcgattatcaacagttctcgctctattacatgcataaaattgttgatggtttactgcgtgaaaacgacggtcgccgcgtaccggtcacgctgtttaccaaaggcggcggacagtggctggaagccatggcagaaaccggttgcgatgcgctgggcctcgactggacaacggacatcgccgatgcgcgccgccgtgtgggcaataaagtcgcgttgcagggtaatatggatccgtcgatgctgtacgcgccgcctgcccgcattgaagaagaagtagcgactatacttgcaggtttcggtcacggcgaaggtcatgtctttaaccttggtcacggcattcatcaggatgtgccgccagaacatgctggcgtgttcgtggaggcagtgcatcgactgtctgaacagtatcaccgctaaggagtgattatggatctcgcgtcattacgcgctcaacaaatcgaactggcttcttctgtgatccgcgaggatcgactcgataaagatccaccggatctgatcgccggagccgatgtcgggtttgagcagggcggagaagtgacgcgagcggcgatggtgctgctgaaatatccctcgcttgagctggtcgagtataaagttgcccgcatcgccaccaccatgccttacattccaggttttctttccttccgcgaatatcctgcgctgctggcagcgtgggagatgctgtcgcaaaagccggatttagtgtttgtcgatggtcatgggatctcgcatcctcgccgtcttggcgtcgccagccattttggcttattggtggatgtgccgaccattggcgtggcgaaaaaacggctctgcggtaaattcgaaccgctctccagcgaaccgggcgcgctggccccactgatggataaaggcgagcagctggcctgggtctggcgcagcaaagcgcgctgtaacccgttgtttatcgctaccggccatcgggtcagcgtggacagcgcgctggcgtgggtacaacgctgcatgaaaggctatcgtctgccggagccaacgcgctgggcggacgcggtggcctcggaacgtccggcgttcgtgcgctatacagcaaatcagccctaattcaggtaaactgcggataatttccgtatttgagaactcaacatgttacaaaacccaattcatctgcgtctggagcgcctggaaagctggcagcatgtcactttcatggcttgcttatgcgaacgcatgtaccccaattacgccatgttctgccagcaaaccggttttggtgatgggcaaatttaccgtcgcattctcgatctcatctgggaaacgctgaccgttaaagacgcaaaagtaaatttcgacagccaactggagaaatttgaagaagcgattccttcagccgacgatttcgatctgtacggcgtttatccggcaatcgatgcctgcgtggcgttaagtgaactggtccattcgcgtttgagtggtgaaacgctcgaacacgcggtggaagtgagtaagacctccatcacgaccgttgcgatgctggaaatgactcaggctggtcgcgaaatgagcgatgaagagcttaaagaaaacccagctgtagagcaagaatgggacattcagtgggaaatattccgacttttagctgagtgcgaagaacgcgatatcgagctgataaaaggccttagggcagacctgcgtgaggcgggtgagagcaatattggtataatttttcagcaataagaccagaaaacgtgatttaacgcctgatttgtcgtacctggagtcttccctttcgccccccgtctggtctacatttggggggcgaaaaaaagtggctatcggtgcgtgtatgcaggagagtgctattctggcatttccgtcgcactcgatgcttagcaagcgataaacacattgtaaggataacttatgaacaagactcaactgattgatgtaattgcagagaaagcagaactgtccaaaacccaggctaaagctgctctggagtccactctggctgcaattactgagtctctgaaagaaggcgatgctgtacaactggttggtttcggtaccttcaaagtgaaccaccgcgctgagcgtactggccgcaacccgcagaccggtaaagaaatcaaaattgccgcagctaacgtaccggcatttgtttctggcaaggcactgaaagacgcagttaagtaagattgcgtggcagtgaacagttttaacgaaggggtggtttcaccccttttgtctttctggcgtcgatcattgatgctggctggcgctctgcttctcactgcctgtagtcataactcttcacttcctccctttaccgccagtggatttgctgaagaccagggcgcggtacgcatctggcgaaaagacagcggcgataatgtgcatctgcttgccgtgtttagcccgtggcgcagtggcgataccacgacgcgagagtatcgctggcagggcgataacctcacgctcatcaatatcaatgtttacagcaaaccgccggtgaatattcgcgcgcgttttgacgatcgcggtgatctgagctttatgcaacgtgaatccgatggggaaaagcagcagctttctaacgaccaaatcgatttataccgttatcgtgctgatcagatccgccagattagcgatgccttacgtcaggggagagtcgtgctgcgccaggggcgctggcatgcgatggaacagaccgtgaccacctgcgaagggcaaaccattaaacctgatttagattcgcaggcgatagcgcatatcgagcgccgccagagccgctcttctgttgatgtcagcgtggcatggctggaagcgcccgaaggttcgcaattactgttagtggcaaactctgatttctgtcgctggcaacccaacgagaaaacgttctgatttaccagtggcccatacccatatgaccgccaccaccgcagccgccgtagcccatgcccattccggctccgcgcggaatacccgcttcagccatcgcgatatctcgtttcacccgtaactcatctaacgactgacgcaaattctccatctctttggcgaccgcgttaattttgctgctatccggtgggttcgcggctaacagggcattgtattcataacgcttcgtcaccagttgctgttgcagtgcgctgctttgagcgtaaaagtcattatggattttctgccacgctgtctgttgttcgctggtcaaaggcgcggcattttgctgccacataccgtgtccgccgtgagcaaatgcagatgtcgatcccatcgccattgctgaaagcgccatcattaccagggcaattttcgtgttccgtttcatggttaatcctccagtggttgtcttacttcgggtattgcatcttccgtgccaacgatgaaacgctgatatgacgggtaatctggcatgataaacgagtaaaaatgactcgcctgctgcgggtagcgagtcatttttactcattgaaacttaagcctttgtgttacagcgcagggtaagcgctgataaaagatggcatgatttctgctgtcagaaagggatgagcaggcaaagaagaagatgcgttttatgcaacgttctaaagactccttagctaaatggttaagcgcgatcctccccgtggtcattgttgggctggtgggattgtttgcggtaactgtgattcgtgattatgggcgggcaagcgaggcagaccgccaggcattactggaaaaaggtaatgtgcttatccgcgctctggagtcgggaagccgcgtagggatggggatgcgaatgcaccatgtacagcaacaggcgcttctggaagagatggcgggacagccgggagtgttgtggttcgcagtcaccgatgcgcagggcatcattattcttcatagcgaccccgataaggtcgggcgtgcgctctattcgccggatgaaatgcagaaattaaagccagaggaaaactcccgctggcggctgcttgggaaaacggaaactacgcctgcacttgaggtctatcgtttgttccagccaatgtcagcgccctggcggcatggaatgcacaatatgccgcgctgtaacggcaaagctgtgccacaagtagatgcacaacaggctatttttatcgccgttgatgccagtgatctggttgcaacccagagtggggaaaagcgcaataccctgattatcctcttcgccctggcgacggtcttgctggcaagcgtattgtcattcttctggtatcgccgctatctgcgctcgcgccagcttctacaagatgaaatgaagcgcaaagagaagctggtggcgctggggcatcttgcggcaggcgttgcccacgaaatccgtaacccactttcctcgattaaaggactggcgaaatactttgccgagcgcgcgcctgcagggggagaagcgcatcaactggcgcaggtgatggcgaaagaggccgaccgtttaaaccgcgtggtaagcgagttgctggaactggttaagccaacgcatctggctttgcaggcggtggatctcaacacgctgattaaccactcattacagctggtaagtcaggatgcaaacagccgggagatccagttacgctttaccgccaacgacacattaccggaaattcaggccgacccggacaggctgactcaggtcctgttgaatctctatctcaatgctattcaggcgattggtcagcatggcgtgattagcgtgacggccagcgaaagcggcgcgggcgtgaaaatcagcgttaccgacagcggtaagggaattgcggcagatcagcttgatgccatcttcactccgtacttcaccactaaagccgaaggcaccggattggggctggcggtcgtgcataatattgttgaacaacacggtggtacaattcaggtcgcaagccaggagggaaaaggctcaacgttcaccctctggcttccggtcaatattacgcgtaaggacccacaaggatgacgcacgataatatcgatattctggtggtggatgatgacattagccactgcactattttgcaggctttactgcgcggctggggctataacgtcgcgctggcgaacagcgggcgacaggcgttggagcaggtgcgggaacaggtttttgatcttgtgctttgcgatgtgcgaatggcggagatggacggcatcgccacgctgaaagagatcaaagcgttaaacccggcaattccggtgctgattatgactgcgtactccagcgtcgagacggcggtagaggcactgaaaactggggcgctggattatctcatcaagccgctggatttcgataacctacaggcgacgctggaaaaagcgctcgcgcatacgcacagtattgatgctgaaacacctgcggtgactgccagccagttcggtatggtcggtaaaagcccggcgatgcaacacctgctcagtgaaatcgccctcgtcgcgccatcggaagccacggtactgatccacggcgattccggcaccggtaaagagctggtcgccagggcgattcacgccagtagcgcacgtagcgaaaaaccgctggtaacgctcaactgtgcggcactcaacgaatccttgctggaatctgaattgttcggtcacgaaaaaggggcgtttactggagccgataaacgccgggaagggcgctttgttgaggcggacggcggcacgctgtttctcgatgaaattggcgatatctcgccgatgatgcaggtgcgtctgctgcgtgcgattcaggagcgcgaagttcagcgtgtcggtagcaaccagattatctcggttgatgtccggctgattgcggcgacccatcgcgatcttgccgcagaggtgaatgccgggcgttttcgccaggatctctactatcgcctgaatgtggtggcgattgaagtaccatcgctgcggcaacggcgggaagatatccctctgctggctggccattttctgcagcgctttgccgagcgtaatcgcaaggcggtaaaaggttttacgccccaggcgatggatctgttgattcattacgactggccgggaaatattcgtgagctggaaaacgcggtggaacgggcagtggtgctgctgaccggggaatatatttccgaacgcgagctgccgctggcgattgccagtacgccgatcccgctgggacaaagtcaggatattcagccgttggtggaagtggaaaaagaggtgattctggcggcgctggagaaaacgggcggcaacaaaaccgaagccgcccgtcagttagggatcacgcgcaaaacgctattggcaaaactgtcgcgttagttctgctcgcgttcgatagcgcgccagccgatatctttccggcagaagcagtcgtcccagtggatatcggtcattaaggcataggcgcgtttctgcgcttctgccacggtatgacccagcgcggtgacgcacagtacgcgcccgccgttggtcactacctgctcgtcatccgccagttttgtgcccgcgtggaacactttgccgcctgccacttcttccagcggcaggccgtggatcacgtcaccggtgcggtaatcacccggatatccacccgcagccatcaccacgccgagagaagcgcgttcatcccactcggacgttttctcgtccagtttgctttcacaggccgccaggcagagctcaaccagatcggacttcatgcgcagcataatcggctgggtttccggatcgccaaagcggcagttaaattcaataaccttcggattgccctgtttgtcgatcatcaggcccgcgtagagaaaaccggtgtaggtgttgccttccgccgccatgcctttcacggttggccagataatacgttccatggtgcgctgatgaacgtcatcggttactaccggcgcgggggagtaagcgcccatcccgccggtgtttggtccggtatctttatcgcctacgcgtttgtgatcctggctggtagccatcggcagcacatgctcgccgtccaccatcacgataaagctcgcttcttcgccatcgaggaactcttcgataacgatgcgatgacccgcgtcgccaaaagcgttgcccgccagcatatcgtgaacagccgcttccgcttcttccagcgtcatcgccacgataacgcctttcccggcagccagaccgtccgctttaatgacgattggcgcgcctttctcacgcagatacgccagcgcaggttctacctcggtgaagttctggtattccgccgtagggatcttatggcgggccaggaaatctttggtaaacgcttttgagccttccagttgggccgcacctgcggttgggccgaagattttcagcccggcggcgcggaaggtatcgaccacgcctttcaccagcggcgcttccgggccgacgatggtcagatcaatcttttcgttttgtgcgaaatccaacagcgccgggatatcggtcacgccaatagcaacgttttgcagcgcgggttccagtgcagtgcctgcattacccggagcaacaaaaacagtctcaaccagcggcgactgggccgctttccaggccagcgcgtgctcgcgcccgccgttaccaatcactaatactttcatctattgctccattaatggcggaagtggcgcatgtcggtgaagagcatcgcaataccgtgctcgtcggcggcggcaatcacttcgtcatcacggatagaaccgccaggctggattacgcaggtcacgcccgcagcggcggcggcatcaataccgtcgcggaacgggaagaacgcgtcagaagccatcgaggaacctttcacttccaggccttcatcggccgctttaataccggcgatttttgcggagtacacgcggctcatctggcccgcgccaatgccgatagtcatattgtttttggcatagacgatagcgttggatttcacaaacttcgccaccttccagcagaacagcgcatcacgcagttcctgttcgctcggctgacgtttggtcaccacgcgcagttcttccgcaccgaccatccccaggtcacgatcctgaaccagcagaccgccgttcacgcgtttgaaatcgaggcccggaacacgctcgccccactgaccgcaggtcagaacgcgtacgttctgtttggcggcggtgattttcagggcttcttcgctggcggacggcgcaataatcacttcgacaaactgacgagaaatgatggcctgtgcggtttccgcatccagctcgcggttaaaggcaatgatgccgccgaatgcggaggttgggtcggttttgtacgcgcgatcgtaagcatcaagaatggaattgccgatagccacgccgcaagggttggcgtgcttcacaatcacacatgccggctcggcgaactctttcacgcactccagcgccgcatcggtatcggcgatgttgttataagagagggctttaccctgaacctgggttgcggtagcaacggaggcttctttcacattctcttctatatagaaggcagcctgctggtggctgttctcgccgtaacgcatatccagcttcttaatgaagttcaggttcagcgtgcgtgggaagcgaccggcggcttctttgctttcaccgtggtaagccggaaccatgctgccgaagtagttggcaatcatgctgtcgtaggcggcagtgtgttcgaaggctttgatggcgaggtcgaaacgggttgcaagcgtcagcgatccttcgttgtcatccatctctttaataatggcgtcatagtcgctgctcttcaccacgattgcgacatctttatggttcttggcggcggagcgcaccatcgttgggccgccgatatcgatgttctcaaccgcatcttccagcgagcaaccttcacgggccacggtctgggcgaacggatacaggttaacaaccaccatatcgataggctggatctgatgttcttccataatggcatcgtcctggccgcgacggcccagaatgccaccatgtactttcggatgcagggtcttcacgcgtccatccatcatctccgggaaaccggtgtaatcggaaacttcggttaccggcagacctttttctgctaacagacgggcagtgccccctgtagacagcagctccacaccgcgtgcggaaagtgcctgggcgaattcgacgataccggctttgtcagaaacactgagcagagcgcggcggactggacgacgttgttgcatggtaaatcccctggatttgactattacagagagcgttagctgaatttttcgcgaaaaactcagctaacgcccctaacggggcatccttatttttcgcccgcattgtaacgaaaacgtttgcgcaacgctcgcgaatttttctctttcaatggtgatcacaattttgactgtggttaccgtgggcaaaatacagaaattacattgatgattgtggataactctgtgcgtaaaaaggtataaagcgggcttttgctggggaatgcagcagtcagtcatttttctgcaatttttctattgcggcctgcggagaactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgcgctaaagcgcgtcgcaactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgcagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgaaagttgttcgtgagtctctcaaattttcgcaacacgatgatgaatcgtaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaggtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaaggtgttttggcggattgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaattagaaaaaccccggtccataaggccggggttttttgcatatcaattatttgcatgatgaagggaatctcatgtcagttctgtatatccaaattcgtcgtaatcaaattactgttcgcgatcttgaaagcaaacgtgaagtgtcaggagacgctgccttcagtaaccagcgcctgttaatcgccaatttctttgttgcagaaaaagttctgcaagatcttgttctgcaactccacccacgttcaacctggcattcttttttgccagcaaaacgtatggatattgttgtgagcgcactggaaatgaatgagggcggtttgtcacaggttgaggaacgcattctccatgaagtggtcgctggggcaacgttaatgaaatatcgccagttccacatccatgcgcaatcagcggtactcagtgatagtgcggtcatggcaatgcttaagcagaaataatcgtgtcaccattggtgggtactaaacctgaagttcagcccaccgggatgagaaaaaatcgcctacgcccccacatacgccagattcagcaacggatacggtttccccaaatcgtccacctcagagcgtcccgtaaccttaaaacccaccttcttatagaacccaaccgcctgctcattttgctcattaacgttggttgtcagttccggtgccatcgagagcgcatgctccaccagcacccgacctacgccgcagccgcgcacatcaggatcgataaacagcgcatccatatgctgcccacttagcaacataaatccaaccggctgatcccgctcattaaccgcgacccacaacggcgcttccggcaggaaggaacgaactaggtcctccagctcggtccgatactctgctgatagaaaatcgtgagtggcatcgacagaacgacaccaaatcgcaacgagttcctccccttcctcatgccgtgagcggcgaatactaataaccattttctctccttttagtcattcttatattctaacgtagtcttttccttgaaactttctcaccttcaacatgcaggctcgacattggcaaattttctggttatcttcagctatctggatgtctaaacgtataagcgtatgtagtgaggtaatcaggttatgccgattcgtgtgccggacgagctacccgccgtcaatttcttgcgtgaagaaaacgtctttgtgatgacaacttctcgtgcgtctggtcaggaaattcgtccacttaaggttctgatccttaacctgatgccgaagaagattgaaactgaaaatcagtttctgcgcctgctttcaaactcacctttgcaggtcgatattcagctgttgcgcatcgattcccgtgaatcgcgcaacacgcccgcagagcatctgaacaacttctactgtaactttgaagatattcaggatcagaactttgacggtttgattgtaactggtgcgccgctgggcctggtggagtttaatgatgtcgcttactggccgcagatcaaacaggtgctggagtggtcgaaagatcacgtcacctcgacgctgtttgtctgctgggcggtacaggccgcgctcaatatcctctacggcattcctaagcaaactcgcaccgaaaaactctctggcgtttacgagcatcatattctccatcctcatgcgcttctgacgcgtggctttgatgattcattcctggcaccgcattcgcgctatgctgactttccggcagcgttgattcgtgattacaccgatctggaaattctggcagagacggaagaaggggatgcatatctgtttgccagtaaagataagcgcattgcctttgtgacgggccatcccgaatatgatgcgcaaacgctggcgcaggaatttttccgcgatgtggaagccggactagacccggatgtaccgtataactatttcccgcacaatgatccgcaaaatacaccgcgagcgagctggcgtagtcacggtaatttactgtttaccaactggctcaactattacgtctaccagatcacgccatacgatctacggcacatgaatccaacgctggattaatcttctgtgatagtcgatcgttaagcgattcagcaccttacctcaggcaccttcgggtgccttttttatttccgaaacgtacctcagcaggtgaataaattttattcatattgttatcaacaagttatcaagtatttttaattaaaatggaaattgtttttgattttgcattttaaatgagtagtcttagttgtgctgaacgaaaagagcacaacgatccttcgttcacagtggggaagttttcggatccatgacgaggagctgcacgatgactgaacaggcaacaacaaccgatgaactggctttcacaaggccgtatggcgagcaggagaagcaaattcttactgccgaagcggtagaatttctgactgagctggtgacgcattttacgccacaacgcaataaacttctggcagcgcgcattcagcagcagcaagatattgataacggaacgttgcctgattttatttcggaaacagcttccattcgcgatgctgattggaaaattcgcgggattcctgcggacttagaagaccgccgcgtagagataactggcccggtagagcgcaagatggtgatcaacgcgctcaacgccaatgtgaaagtctttatggccgatttcgaagattcactggcaccagactggaacaaagtgatcgacgggcaaattaacctgcgtgatgcggttaacggcaccatcagttacaccaatgaagcaggcaaaatttaccagctcaagcccaatccagcggttttgatttgtcgggtacgcggtctgcacttgccggaaaaacatgtcacctggcgtggtgaggcaatccccggcagcctgtttgattttgcgctctatttcttccacaactatcaggcactgttggcaaagggcagtggtccctatttctatctgccgaaaacccagtcctggcaggaagcggcctggtggagcgaagtcttcagctatgcagaagatcgctttaatctgccgcgcggcaccatcaaggcgacgttgctgattgaaacgctgcccgccgtgttccagatggatgaaatccttcacgcgctgcgtgaccatattgttggtctgaactgcggtcgttgggattacatcttcagctatatcaaaacgttgaaaaactatcccgatcgcgtcctgccagacagacaggcagtgacgatggataaaccattcctgaatgcttactcacgcctgttgattaaaacctgccataaacgcggtgcttttgcgatgggcggcatggcggcgtttattccgagcaaagatgaagagcacaataaccaggtgctcaacaaagtaaaagcggataaatcgctggaagccaataacggtcacgatggcacatggatcgctcacccaggccttgcggacacggcaatggcggtattcaacgacattctcggctcccgtaaaaatcagcttgaagtgatgcgcgaacaagacgcgccgattactgccgatcagctgctggcaccttgtgatggtgaacgcaccgaagaaggtatgcgcgccaacattcgcgtggctgtgcagtacatcgaagcgtggatctctggcaacggctgtgtgccgatttatggcctgatggaagatgcggcgacggctgaaatttcccgtacctcgatctggcagtggatccatcatcaaaaaacgttgagcaatggcaaaccggtgaccaaagccttgttccgccagatgctgggcgaagagatgaaagtcattgccagcgaactgggcgaagaacgtttctcccaggggcgttttgacgatgccgcacgcttgatggaacagatcaccacttccgatgagttaattgatttcctgaccctgccaggctaccgcctgttagcgtaaaccaccacataactatggagcatctgcacatgaaaacccgtacacaacaaattgaagaattacagaaagagtggactcaaccgcgttgggaaggcattactcgcccatacagtgcggaagatgtggtgaaattacgcggttcagtcaatcctgaatgcacgctggcgcaactgggcgcagcgaaaatgtggcgtctgctgcacggtgagtcgaaaaaaggctacatcaacagcctcggcgcactgactggcggtcaggcgctgcaacaggcgaaagcgggtattgaagcagtctatctgtcgggatggcaggtagcggcggacgctaacctggcggccagcatgtatccggatcagtcgctctatccggcaaactcggtgccagctgtggtggagcggatcaacaacaccttccgtcgtgccgatcagatccaatggtccgcgggcattgagccgggcgatccgcgctatgtcgattacttcctgccgatcgttgccgatgcggaagccggttttggcggtgtcctgaatgcctttgaactgatgaaagcgatgattgaagccggtgcagcggcagttcacttcgaagatcagctggcgtcagtgaagaaatgcggtcacatgggcggcaaagttttagtgccaactcaggaagctattcagaaactggtcgcggcgcgtctggcagctgacgtgacgggcgttccaaccctgctggttgcccgtaccgatgctgatgcggcggatctgatcacctccgattgcgacccgtatgacagcgaatttattaccggcgagcgtaccagtgaaggcttcttccgtactcatgcgggcattgagcaagcgatcagccgtggcctggcgtatgcgccatatgctgacctggtctggtgtgaaacctccacgccggatctggaactggcgcgtcgctttgcacaagctatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactacgttgagaaagtgcagcagccggaatttgccgccgcgaaagatggctataccttcgtatctcaccagcaggaagtgggtacaggttacttcgataaagtgacgactattattcagggcggcacgtcttcagtcaccgcgctgaccggctccactgaagaatcgcagttctaagcaacaacaaccgttgctgactgtaggccggataaggcgttcacgccgcatccggcaatcggtgcacgatgcctgatgcgacgcttgcgcgtcttatcatgcctacagccgttgccgaacgtaggctggataaggcgtttacgccgcatccggcaattctctgctcctgatgagggcgctaaatgccgcgtggcctggaattattgattgctcaaaccattttgcaaggcttcgatgctcagtatggtcgattcctcgaagtgacctccggtgcgcagcagcgtttcgaacaggccgactggcatgctgtccagcaggcgatgaaaaaccgtatccatctttacgatcatcacgttggtctggtcgtggagcaactgcgctgcattactaacggccaaagtacggacgcggcatttttactacgtgttaaagagcattacacccggctgttgccggattacccgcgcttcgagattgcggagagcttttttaactccgtgtactgtcggttatttgaccaccgctcgcttactcccgagcggctttttatctttagctctcagccagagcgccgctttcgtaccattccccgcccgctggcgaaagactttcaccccgatcacggctgggaatctctactgatgcgcgttatcagcgacctaccgctgcgcctgcgctggcagaataaaagccgtgacatccattacattattcgccatctgacggaaacgctggggacagacaacctcgcggaaagtcatttacaggtggcgaacgaactgttttaccgcaataaagccgcctggctggtaggcaaactgatcacaccttccggcacattgccatttttgctgccgatccaccagacggacgacggcgagttatttattgatacctgcctgacgacgaccgccgaagcgagcattgtttttggctttgcgcgttcttattttatggtttatgcgccgctgcccgcagcgctggtcgagtggctacgggaaattctgccaggtaaaaccaccgctgaattgtatatggctatcggctgccagaagcacgccaaaaccgaaagctaccgcgaatatctcgtttatctacagggctgtaatgagcagttcattgaagcgccgggtattcgtggaatggtgatgttggtgtttacgctgccgggctttgatcgggtattcaaagtcatcaaagacaggttcgcgccgcagaaagagatgtctgccgctcacgttcgtgcctgctatcaactggtgaaagagcacgatcgcgtgggccgaatggcggacacccaggagtttgaaaactttgtgctggagaagcggcatatttccccggcattaatggaattactgcttcaggaagcagcggaaaaaatcaccgatctcggcgaacaaattgtgattcgccatctttatattgagcggcggatggtgccgctcaatatctggctggaacaagtggaaggtcagcagttgcgcgacgccattgaagaatacggtaacgctattcgccagcttgccgctgctaacattttccctggcgacatgctgtttaaaaacttcggtgtcacccgtcacgggcgtgtggttttttatgattacgatgaaatttgctacatgacggaagtgaatttccgcgacatcccgccgccgcgctatccggaagacgaacttgccagcgaaccgtggtacagcgtctcgccgggcgatgttttcccggaagagtttcgccactggctatgcgccgacccgcgtattggtccgctgtttgaagagatgcacgccgacctgttccgcgctgattactggcgcgcactacaaaaccgcatacgtgaagggcatgtggaagatgtttatgcgtatcggcgcaggcaaagatttagcgtacggtatggggagatgcttttttgagtaaagcttccatataatttttctccgcaatgtatcgagggttatccgtaaagccaaagctttcagccatcttatttaatgtattaaggattaattcagcaataacccggtgaccaaattcaaaagccaactcaaaggcagagtatttttgtggggctttgtgttgccaaaaatccataatatcttcagcggtaaatccaaacaggcgtgcatggtcagataaagcaagataaaccgtctctacaacattttgttgtttatgctgtatcgctgaaaacaaaccgggatattcattagaattatttgccaggaggaggggcttcatattttttttatcgaatttaaacgtattaaacagagtgggtaatgcgttaaaaatagtattaataacgttcatgtgtccgcgctgcatggccataaacaaacccgtgtcgcgcgcaagacttttagcggtcagaagatctacaatatcggaagctgaaatgttaatttcctgggctaggctgggcaatgcttcaagaataactttcacgatatcgctatgtccattttgcatcgccagatatagtcctgggcaaccataaaaatcctttgccttcaggagatcgagtacctgttctttagtcaaatgacatgtgcgaattaacaaaggtaacgcgttcaaaacaattttcagcatgtcggcatcaccattcgccataacatggtataaaacatggctggacgttctatttttggcactcaggaatttatacacttgttcgttatctaaatgatgtgttgcggccagtttaggtaaggcgttcagaatcgaggttacaacatttttatccttacgtgatatcgctaaaaataatccagaaaaaccatttttatcttttgcctccagaatatgcatgagattttttttcgagagtaatccttcatatcctgtttctgacaatgaattgaaaatagtctcaacgatatccgcattaccataatttatagccaaatataaacctggcaggttaatactattataggcagtcaacatttctgttctatgtagttctggcattttctggagttgaatcatcagttgcgtaagttggtgattctgaccaattgccattagcaaattcatcgttgcaggtgataatggaggggttatttcatccacagatccttttaacatcaatagctgttctttcggaagtgctggaattattgcaacagattgattaataacatgatcatttgaccatttcaggaggctataatctacattcataaaatccatcagagaatagtgtttaatattctctttgctttcgctcataattcttattttatcgttagttacattaggatcataaaccgaaaccacgtaatgggtacatccttcagttgtgttctttattcttagccggaccgtcaaagcatggttatccaccagtaatatggctgccataacactgatgccatttgattccatcttgtcaaaatatgctttcataactagcccgaaatcaccgcaggcagcaacgcaacgcccctcaggacggctggaaaccaacgccaaagtctggtttttgcattttttgttgaagtgcgtgagaaatttttcagctgaagagtaatcatcttgatggggtttgtaatcaacattctgataaatatcattaatatattgtgcagcaatgtgtcggcatactatacggttttggggtcgccccggaaaataacattgaccattaagtttaattcttgggaattctttttcttttctatctgattttaggtttaattcttgtttatcaagagtgtctgagcgttgaggtaaaatttccattaggtatttttcaaatattggggcaatggtttgagtaagtgtcgtgttttcgtttttattaattatcgtaatttctttcttatcagcttgtaagacggacgtggaaaatttaatgacaaaatccttgttgctaaagatatgacgaccattttgtctacagttctctgagaagctttttaatagaggcgtcgccagctccttgccagaaaatttatcctcgagttctttataaaacaattcactcagggtttggtgttcatttgtctgggctgtattattaatatttgcagagaaagaactacgaggaatacgagtaatcatttaaatatctcattgtttattgatgtcttgaattttaactatcagaacagtgaaaaaatttaatatgattacaactaaagaaatatcataaatcgctcaatctcataatgcagccgtaaaagtttcggtggaatgagatcttgcgattttgttaataattaagtggtttgatgtttaaaaataatgctgagttaataaaagtgtgtgaagtgtatgacattaagttattttggcgtcaatgcgattaacagacacccttattctattgccactcaggtatgatgggcagaatattgcctctgcccgccagaaaaagtcagcgcattccaccgtacgccagcgtcacttccttcgccgctttaatcaccatcgcgccaaactcggtcacgcggtcatcggtaatacgtgaaatcggtccggaaatagaaattgcggcaaacggttcacggtgctcatcgaaaatacacgctgcaaggcaacgtagccccagtgcatgttcctcatcgtcaaatgaataaccccgtttgcgcgtttgggcgagatcttcttttaaatgcacaggagacaccagcgttgcgtgggtataggcatgtaaccctttgcggtgcagcagcttcgtcacctgttcttcgctcagttgggctaaaaaggctttacccgcaccggaagcgtgcatcggcaatttaccgccgataggcgcggacattcgcatcagatgcgtacactgtacctggtcgataataatcgcttcgtgatcgctttgatcaagcaccgccatattgaccgtttcgccagactcttccattagattgcgcaggatagggtgaacaatcgctaacaaattacggctctggagaaagctgctgccgaccataaaggcatgtgcgccgattgcccaatgtcccagttcgccaacctgacgcacgaaaccctgctgttgcatcgtggttagcaggcggtgggtcgtggaattgggtaacccggcttgttgcgccagttccgtgagtgccacactgccattggattcggcaatccactccagtaatttcaggccacgcgttaaagactgaacctgtccagtcgctggtgcggtggcaacggcgggttttctgccgcgtttcgcgggaatgggtgcgaccatgacagtctcttttttctgtatcgtggaaatcattttcatttttattgttagctaatgcaatagttactgaactgatccgatgagttaatgttgaacaaatctcatgttgcgtggtggtcgcttttaccacagatgcgtttatgccagtatggtttgttgaatttttattaaatctgggttgagcgtgtcgggagcaagtgtgagcagcaaagtggaacaactgcgtgcgcagttaaatgaacgtattctggtgctggacggcggtatgggcaccatgatccagagttatcgactgaacgaagccgattttcgtggtgaacgctttgccgactggccatgcgacctcaaaggcaacaacgacctgctggtactcagtaaaccggaagtgatcgccgctatccacaacgcctactttgaagcgggcgcggatatcatcgaaaccaacaccttcaactccacgaccattgcgatggcggattaccagatggaatccctgtcggcggaaatcaactttgcggcggcgaaactggcgcgagcttgtgctgacgagtggaccgcgcgcacgccagagaaaccgcgctacgttgccggtgttctcggcccgaccaaccgcacggcgtctatttctccggacgtcaacgatccggcatttcgtaatatcacttttgacgggctggtggcggcttatcgagagtccaccaaagcgctggtggaaggtggcgcggatctgatcctgattgaaaccgttttcgacacccttaacgccaaagcggcggtatttgcggtgaaaacggagtttgaagcgctgggcgttgagctgccgattatgatctccggcaccatcaccgacgcctccgggcgcacgctctccgggcagaccaccgaagcattttacaactcattgcgccacgccgaagctctgacctttggcctgaactgtgcgctggggcccgatgaactgcgccagtacgtgcaggagctgtcacggattgcggaatgctacgtcaccgcgcacccgaacgccgggctacccaacgcctttggtgagtacgatctcgacgccgacacgatggcaaaacagatacgtgaatgggcgcaagcgggttttctcaatatcgtcggcggctgctgtggcaccacgccacaacatattgcagcgatgagtcgtgcagtagaaggattagcgccgcgcaaactgccggaaattcccgtagcctgccgtttgtccggcctggagccgctgaacattggcgaagatagcctgtttgtgaacgtgggtgaacgcaccaacgtcaccggttccgctaagttcaagcgcctgatcaaagaagagaaatacagcgaggcgctggatgtcgcgcgtcaacaggtggaaaacggcgcgcagattatcgatatcaacatggatgaagggatgctcgatgccgaagcggcgatggtgcgttttctcaatctgattgccggtgaaccggatatcgctcgcgtgccgattatgatcgactcctcaaaatgggacgtcattgaaaaaggtctgaagtgtatccagggcaaaggcattgttaactctatctcgatgaaagagggcgtcgatgcctttatccatcacgcgaaattgttgcgtcgctacggtgcggcagtggtggtaatggcctttgacgaacagggacaggccgatactcgcgcacggaaaatcgagatttgccgtcgggcgtacaaaatcctcaccgaagaggttggcttcccgccagaagatatcatcttcgacccaaacatcttcgcggtcgcaactggcattgaagagcacaacaactacgcgcaggactttatcggcgcgtgtgaagacatcaaacgcgaactgccgcacgcgctgatttccggcggcgtatctaacgtttctttctcgttccgtggcaacgatccggtgcgcgaagccattcacgcagtgttcctctactacgctattcgcaatggcatggatatggggatcgtcaacgccgggcaactggcgatttacgacgacctacccgctgaactgcgcgacgcggtggaagatgtgattcttaatcgtcgcgacgatggcaccgagcgtttactggagcttgccgagaaatatcgcggcagcaaaaccgacgacaccgccaacgcccagcaggcggagtggcgctcgtgggaagtgaataaacgtctggaatactcgctggtcaaaggcattaccgagtttatcgagcaggataccgaagaagcccgccagcaggctacgcgcccgattgaagtgattgaaggcccgttgatggacggcatgaatgtggtcggcgacctgtttggcgaagggaaaatgttcctgccacaggtggtcaaatcggcgcgcgtcatgaaacaggcggtggcctacctcgaaccgtttattgaagccagcaaagagcagggcaaaaccaacggcaagatggtgatcgccaccgtgaagggcgacgtccacgacatcggtaaaaatatcgttggtgtggtgctgcaatgtaacaactacgaaattgtcgatctcggcgttatggtgcctgcggaaaaaattctccgtaccgctaaagaagtgaatgctgatctgattggcctttcggggcttatcacgccgtcgctggacgagatggttaacgtggcgaaagagatggagcgtcagggcttcactattccgttactgattggcggcgcgacgacctcaaaagcgcacacggcggtgaaaatcgagcagaactacagcggcccgacggtgtatgtgcagaatgcctcgcgtaccgttggtgtggtggcggcgctgctttccgatacccagcgtgatgattttgtcgctcgtacccgcaaggagtacgaaaccgtacgtattcagcacgggcgcaagaaaccgcgcacaccaccggtcacgctggaagcggcgcgcgataacgatttcgcttttgactggcaggcttacacgccgccggtggcgcaccgtctcggcgtgcaggaagtcgaagccagcatcgaaacgctgcgtaattacatcgactggacaccgttctttatgacctggtcgctggccgggaagtatccgcgcattctggaagatgaagtggtgggcgttgaggcgcagcggctgtttaaagacgccaacgacatgctggataaattaagcgccgagaaaacgctgaatccgcgtggcgtggtgggcctgttcccggcaaaccgtgtgggcgatgacattgaaatctaccgtgacgaaacgcgtacccatgtgatcaacgtcagccaccatctgcgtcaacagaccgaaaaaacaggcttcgctaactactgtctcgctgacttcgttgcgccgaagctttctggtaaagcagattacatcggcgcatttgccgtgactggcgggctggaagaggacgcactggctgatgcctttgaagcgcagcacgatgattacaacaaaatcatggtgaaagcgcttgccgaccgtttagccgaagcctttgcggagtatctccatgagcgtgtgcgtaaagtctactggggctatgcgccgaacgagaacctcagcaacgaagagctgatccgcgaaaactaccagggcatccgtccggcaccgggctatccggcctgcccggaacatacggaaaaagccaccatctgggagctgctggaagtggaaaaacacactggcatgaaactcacagaatctttcgccatgtggcccggtgcatcggtttcgggttggtacttcagccacccggacagcaagtactacgctgtagcacaaattcagcgcgatcaggttgaagattatgcccgccgtaaaggtatgagcgttaccgaagttgagcgctggctggcaccgaatctggggtatgacgcggactgattcacaaatctgtcacttttccttacaacaaacagggcgctcaatgagtgccctgtctctttattaatatgaaacacttatactggaaacaggctggaataatcttagccggaaaaacgaatgtcaaaaggcacagtaaagatgccagtcagcgtgtttccggtcctttggtcattcaattgcttcaggaacatataacgataaggagaacctgaactcgtgttaacgctgcttcacctgctttctgccgtcgccctgctggtctgggggactcatattgttcgaaccggcgtaatgcgcgtcttcggcgcgcgtttgcgtactgtccttagccggagcgtcgaaaaaaagccgctcgccttttgcgcggggatcggcgttaccgcactggtacagagcagtaatgccaccaccatgctggtgacctcgtttgtcgctcaggatctggtagccctcgcaccggctctggtcattgtgctgggtgcagatgtcgggacggcgctaatggcgcgtattctcaccttcgacttatcctggctgtcaccgttacttatttttatcggcgtgatttttttcctcggacgcaaacagtcacgcgccgggcaactgggccgcgtcggtattggtcttgggctgattttgctagcgctggagttgattgtgcaggccgtaacgccgatcacccaggcaaacggcgttcaggtgatctttgcctcgctgaccggcgatattctgctggatgcgctgattggcgcgatgttcgccattatcagctactccagccttgctgctgtactgctgaccgcgactctgaccgccgcaggcattatctccttccccgtggcgctctgtctggtgattggtgctaacctcggttccggtctgctggcaatgctcaacaacagtgccgccaatgccgcagcccgccgtgtcgcgctgggtagtctgctgtttaagctggtgggtagcctgattatcctgccgtttgtccatttgctggcagagacaatggggaagttgtcattgccaaaagcggaactggtgatctatttccacgtcttctacaaccttgtacgttgcctggtcatgctgccatttgttgacccgatggcacggttttgcaaaacgattattcgcgatgaaccggaactggatacccagctacggcctaaacatctggatgtcagcgcgctggatacgcccacgcttgctctggcgaacgccgcgcgcgaaaccctgcgcattggcgacgccatggaacagatgatggaagggttgaataaagtgatgcacggtgagccacggcaggagaaagagctgcgtaagctggcagatgatatcaacgttctctacaccgccattaagctgtatctggcgcggatgccaaaagaagagctggcggaggaagagtcgcgccgctgggcagagatcatcgaaatgtcgctcaaccttgaacaggcctccgatatcgtcgagcgcatgggcagcgaaattgctgacaaatcactggcagcacggcgggcattttcgcttgatgggttgaaggaactggatgcgctctatgagcaattgctcagtaatttaaagctggcaatgtcggtgttcttctctggcgatgtcaccagcgctcgtcgtttgcgtcgcagcaaacatcgttttcgcattcttaatcgccgctattcccacgcccacgtcgatcgcctgcatcagcaaaacgtgcagagcattgaaaccagttcgctacatttaggcttactgggagatatgcagcgcctgaactcgctgttttgttcggtggcttacagtgtgctggaacagccggatgaagatgaaggacgggacgagtattaatattgtgaatcctgtaggcctgataagacgcgtcaagcgtcgcatcaggcactatgaacaagatgccggatcatgcatccggcaattcacttaaaaacggtgaccagcttccagcggaaccgcttcttcaccagccttaaacacataagtggtgttcgggccacccagcgtagcgtgacctttactcactgtgatccagttaccttccggtagaccaataatcgtcagttctggcgcgacgaccagcagttcgcgaatacgctgctcacgggtttcacctttatggccttccggcagcgcgttggtgaagtgcgggttgatttgcagcgggaacagatttagcgcatcgaaaccttgcggatcgacaatcggcatatcgttggtggtacgaatagttgggcaagcaaggttagcgcctgcgctccagccaatatacagagcgccacgtttaaccacgtcagtaattggtgccagcagcccgcgctcgcggcactgtttcagcaactggaaagtattcccgccgccgacaatcacgatctcagcattttcaatcgcggcaacgggatcgacaacgctatgaataccggtgacagaaacacccagcggagcgagaaccgcagccgttttcgctgtgtaatcatcccaggtctgcgttacgccagcgaaagggataaacaccgctgagcggcgaccctgcaactgttcagcaattagcggcagtgcatgttccagccaggctttacccggcagcgtcgagttactcaataaaagcagttccattacttctccggttagtaagaaatcacgggaggcatgctaccactgcgaatttaaccacttactgacatggctcacgatgtcgcacattgcttctggaaagtgatttgagcaggtaacgaattcaagccaatggaaataacaaatagttcgctcatgactattttttatcaacccaaaggtacggtatattccgttttttacaggagaatttatgctgcccgactcatcagtccgtttaaataaatacatcagcgaaagcggaatttgctcacgccgcgaagcggatcgctatatcgagcaaggcaatgtgttccttaatggcaagcgagccaccattggcgatcaggtgaaacccggcgacgttgtgaaagtaaacggtcagttgattgaacctcgggaagccgaagatttggtacttatcgccctgaacaagcccgttggtattgtaagcaccaccgaagatggcgagcgcgataacattgtcgatttcgttaaccacagcaaacgcgtgttcccgattggccgcctggataaagactcccaggggctgattttcctcaccaatcacggcgatctggtgaataagatcctgcgtgctggcaatgatcatgagaaagagtatctggtgacggtcgataaaccgattaccgaggagtttattcgcggcatgagtgcgggggtgccaatcctcgggacagtgaccaaaaagtgcaaagttaaaaaagaagcgccgtttgtcttccgcattaccctggtgcaggggctgaaccgtcagatccggcgcatgtgcgagcatttcggctatgaagtgaaaaagctggaacgcacgcgcatcatgaacgttagcttaagcggcattccgctgggggaatggcgcgatttaaccgacgatgagttaatcgacctctttaagctcattgaaaattcctcttccgaggtaaaacctaaagcgaaggccaaaccgaaaacagcgggcatcaaacgtccagtcgttaagatggaaaaaacggcggaaaaaggcggtcgcccggcgtccaacggtaagcgttttacctcgccggggcgtaaaaagaaggggcgctgattaacgcctcagactgatgaaaacggcccaaaagtgcccggacagtcccctcgccccttcgggaaaagggttagggtgaggggaaaattgtgttcacactgacgagtgaaaatctcaggcgttgattgtggattagcgcctgccgcgcgtcgacgtatttgctgaccagctaaatgacgcttcaggatccggtttataagcctgctttttcttcaactggcgggcttttttcgcttcagcctcacgctcaaccattaatttatcgatgtaatctttcttaatgctgttggtttcggagttggtcaatacgcgaccatgcgcaatccgcgcccgatccagcagtgttttaagttcacgctgctcgcgttcagtcatctctttttgggtaatacgggggagtgccatgatggtgccctcagtgagccagagagttcagtgtacgggaattcgtttgcgagcagaactgataatattcattttgccttctcttaactatttatctctttcgataattaattagagatgcagataaaaaaattaaaggcaattattctccgataaagacgctggttaacagagtacaggctcgtttattgatgagcatagtgacaagaaaatcaatacggcccgaaatatagcttccaggccatacagtatttactcaaacaaattactatgcagtttttgcaccacctgctcggcatcttcgccgggcaccaggaagcacaggttatggctggatgcgccataacaaatcatgcgaatgttgaacggttccagtacgccgaatacctctttgccaacgccgcaggcttttgacaggtcattgccaatcaacgcgaccagcgccagaccttcttccacctccacccgacacagtgcggaaagctccatcagcagagattgcgtcagcaacgtatcgccagtggaggttgaaccggtggtatcaagggttaatgccacgctcacttctgacgtggtgattaagtctaccgaaatattatgccgcgcgaggatgccgaaaacttccgcgaggaaaccgcgagaatgcagcatattcaggctgtgcaaagtgagcagagtctgattgcgacgaagcgccagagcgcggaacagcggcggattttcagttttattgcacaccagcgtaccacctgcgcgtgggtctttgctggagccgacaaagaccgggatatcgctgcgtactgcgggtagcaacgttgccggatgcagtacttttgcaccaaaagttgccatctctgccgcttcggcaaacgcgatttcatcaatgcgttttgctgcggaaactacgcgtggatcggtggtgtagatgcccgggacgtcggtccagatatcaacacgagatgcgtgtaaagcctccgccagcaaggctgccgtataatcgctgcctccacggccaagcgtcgttgtacgacctttattttcgctaccgataaatccctgggtgatcactaagccttcattgagacgtgggagcagctgcagcgcggccagttccgccagcgcggctatatctggctctgcacgaccaaatcggtcgttggtacgcatcactttacgtacatcaaaccactgtgcctgaacatcgcgttcgcgcaggatctcaacaaacagcagggtcgacatcagctcgccgtggctgaccagctcatctgtcagcgccggagacgttgccagcgccgccgcttctgccagaacagtaatgttctccagcagacgttcaatctcttcacggataacgttcgggtaacgcagacgttccagaatggcaaactggatgttgcggatagcgtcgagtttttcgaatcgctcgccaggttccagtccttcagctaaagcgaccagcagattagtgataccagcagaagccgagaggacaactaaacgcacgttggcatcagaaagcacaatatcagcgctgcggttcatggcgtcaaaatcagctacgctggtaccgccaaatttggagacaacaatttcagacataactacctcgtgtcaggggatccattttcagccttggcacaagggaagagcggaagacgggtgggcgcagagcgatacttcgctactattttcacccagaagtgctccaccacttgcgaaacgcccgactgcgaacgcttctggtgacaacccaggggattcagcccctgtagccgatgatgaacgtggccagccgttcaatcacctcggcgatgcaccccctcaggtgttatcacaggactggctcctccaacaccgttacttgggcaacgcgcctcttctggcctgcgctagcgcaggtagtacatttataaataaagggtgagcggggcggttgtcaacgatggggtcatgcggatttttcatccactcctggcggtcagtagttcagctaataaatgcttcactgcgctaagggtttacactcaacattacgctaacggcactaaaaccatcacatttttctgtgactggcgctacaatcttccaaagtcacaattctcaaaatcagaagagtattgctaatgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaggatctggcgaaagagtgcgatctggcgggcgcgattaagtcgatgttctctggcgagaagatcaaccgcactgaaaaccgcgccgtgctgcacgtagcgctgcgtaaccgtagcaataccccgattttggttgatggcaaagacgtaatgccggaagtcaacgcggtgctggagaagatgaaaaccttctcagaagcgattatttccggtgagtggaaaggttataccggcaaagcaatcactgacgtagtgaacatcgggatcggcggttctgacctcggcccatacatggtgaccgaagctctgcgtccgtacaaaaaccacctgaacatgcactttgtttctaacgtcgatgggactcacatcgcggaagtgctgaaaaaagtaaacccggaaaccacgctgttcttggtagcatctaaaaccttcaccactcaggaaactatgaccaacgcccatagcgcgcgtgactggttcctgaaagcggcaggtgatgaaaaacacgttgcaaaacactttgcggcgctttccaccaatgccaaagccgttggcgagtttggtattgatactgccaacatgttcgagttctgggactgggttggcggccgttactctttgtggtcagcgattggcctgtcgattgttctctccatcggctttgataacttcgttgaactgctttccggcgcacacgcgatggacaagcatttctccaccacgcctgccgagaaaaacctgcctgtactgctggcgctgattggcatctggtacaacaatttctttggtgcggaaactgaagcgattctgccgtatgaccagtatatgcaccgtttcgcggcgtacttccagcagggcaatatggagtccaacggtaagtatgttgaccgtaacggtaacgttgtggattaccagactggcccgattatctggggtgaaccaggcactaacggtcagcacgcgttctaccagctgatccaccagggaaccaaaatggtaccgtgcgatttcatcgctccggctatcacccataacccgctctctgatcatcaccagaaactgctgtctaacttcttcgcccagaccgaagcgctggcgtttggtaaatcccgcgaagtggttgagcaggaatatcgtgatcagggtaaagatccggcaacgcttgactacgtggtgccgttcaaagtattcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggaactgggtaaacagctggcgaaccgtattctgccagagctgaaagatgataaagaaatcagcagccacgatagctcgaccaatggtctgattaaccgctataaagcgtggcgcggttaatcatcgtcgatatgtaggccggataaggcgttcacgccgcatccggcaaccgatgcctgatgcgacgcggtcgcgtcttatcaggcctacaggtcgatgccgatatgtacatcgtattcggcaattaatacatagcacgattgattaaataaccttaataacaatgccgacgttatgtcggcatttttttatcagataaatccccttgtctgtaatttaacggaaatcataccgtgaggttaatcctaaaatagatttttaatcgttgtttatttcggaaaatacgcagattaattgcttttgtttttattttaagtttatgatttttattgttatttaaatataagttgaaacttatatttgatattcattccaattatcctaaaacgccatcgctaattccccgcgccgtaattcgcatgctttagttgtgtatactcgatcccgcccgaaatgtttttgggtaaatctccattcattcaatgaagggaaattgttatgaaaaaagttctgtatggcatttttgccatatctgcgcttgcggcgacttctgcgtgggctgcacctgtacaggtgggcgaagcggcagggtcggcagcaacgtcggtttcggcggggagttcctccgcgaccagcgtcagcaccgtaagctcggcggtgggtgtcgcgcttgcggcaaccggtggcggtgatggttctaataccgggaccaccacaaccacgaccaccagtacccagtaataaagtatgtatccccaaaataattcgagtcattgcatctgtggctagaagtatgaagggattaaccataaccacactccggtgtggttattctgcccctctggagaagagtcgtgaagcgacctgcactcattcttatctgcctgttattacaggcctgttcagccacgactaaagagctgggcaattcactgtgggacagtctgttcggcacgccaggcgtacagctgacggatgatgatattcaaaatatgccctacgccagccagtacatgcagcttaatggcgggccgcagttatttgtggtgctggccttcgctgaagacggacaacaaaaatgggtcactcaggatcaggctactctcgttacccaacatggccgtctggtgaagactctgctcggcggcgacaacctgattgaagtgaataaccttgctgccgacccgctgattaaacccgcacaaatcgttgatggcgcaagctggacgcgcacgatgggctggaccgagtaccagcaggtacgctacgccaccgcacgctcagtcttcaaatgggatggcaccgataccgtcaaagtcggcagcgatgaaaccccggttcgcgtgctggacgaagaagtctccaccgaccaggcgcgctggcataaccgctattggatcgacagcgaagggcaaattcgccagtcggaacagtatctcggcgcggattattttccggtgaaaaccactctcatcaaggcggcaaaacaatgattaaacaaactattgtcgcgttgcttttgagtgtgggagcgtcatcggtcttcgcggcaggaaccgtcaaggtgttcagcaatggcagcagtgaggccaaaacgctaacgggcgcagagcatttaatcgatctggtaggccaaccgcggctggcaaacagctggtggcccggtgcggtgattagcgaagagctggcaacggcggcagcattgcgtcagcagcaggcgttgctgacacggctggcagaacagggcgcagattccagcgccgacgatgccgctgcgattaacgccttacgccagcaaattcaggcgttgaaagtgacgggcaggcaaaaaatcaatcttgatcccgatatcgtccgcgttgccgaacgcggtaacccgccgttgcagggcaactacacgctgtgggtcggaccaccgccgtccacggtcacgttgttcgggcttatcagccgtcctggcaagcagccattcactccaggtcgcgacgtggcgagctatctctctgaccagagcctgctcagcggtgcggatcgcagctacgcgtgggtggtttacccggacggacgcacgcaaaaagcgccggtggcttactggaacaagcgtcacgtagagccgatgcccggcagcattatttatgttggcctcgcggactccgtctggagtgagacgcctgatgcccttaacgccgacattcttcagactctgacgcagcggatacctcaataatgaaaaaaagacatctgcttagcttactggcgctgggcattagcacagcttgctacggcgaaacatatcctgcgcccattggtccgtcgcagtcggatttcggtggcgtaggattattacaaacgcccaccgcgcgtatggcacgggaaggggagttgagtctgaactatcgcgataacgatcagtaccgttattactcagcttcagtgcaactcttcccgtggctggaaacaacgctgcgctacaccgacgtgcgcacccggcagtacagcagcgtcgaagcgttctctggcgatcaaacgtataaagataaagccttcgatctcaaactgcgtttgtgggaagagagttactggctgccgcaagtggcggttggtgcgcgggatatcggcggtacggggctgtttgatgcggaatatcttgttgccagcaaagcctgggggccgttcgattttacgctcggcctgggctgggggtatttgggcaccagcggtaatgtgaaaaatccgctctgttcagccagtgataaatattgctatcgcgataacagctacaaacaggcgggatctatcgacggtagccagatgttccacggtcctgcctcactgtttggcggcgtggaataccagacgccctggcaaccgctgcgcctgaaactggagtatgaaggcaataattatcagcaggattttgccgggaagctggagcaaaaaagtaagtttaacgtcggtgcgatttatcgcgttaccgattgggccgacgttaaccttagctatgaacgtggcaacacctttatgtttggcgttacgttgcgcaccaactttaacgatctgcgcccgtcttacaacgataacgcccgcccgcaatatcaaccgcagccgcaggatgccattttgcagcattcggtggtggcgaatcagttaacgctgttgaaatacaatgccggacttgccgatccacagatccaggcgaaaggcgatacgctgtatgttaccggcgagcaggtgaaatatcgtgattcgcgcgaagggatcatccgtgcgaatcggatcgtgatgaacgatctgccggatgggatcaaaacgatccgcattacggaaaatcgccttaacatgccgcaggtgacgacggaaaccgatgtcgccagcctgaaaaatcatctcgccggagagccgttgggccacgaaacgacgctggcgcaaaaacgcgtcgagccagtggttccgcagtccaccgagcagggctggtatatcgacaaatcacgctttgatttccatatcgatccggtgctgaaccagtcggtcggtggcccggaaaacttttacatgtatcagctgggcgtgatgggaacggcagatttgtggctgacggaccatctgctgaccaccggcagcctgtttgcaaatcttgccaacaactacgacaagtttaactacactaatcctccgcaggactcgcacttaccgcgcgtgcgtacccatgtgcgcgagtatgtgcagaacgatgtctatgtgaataacctgcaagccaactacttccagcatctgggcaacggcttctacggtcaggtctacggtggttatctcgaaaccatgtttggcggtgcgggggcagaagtgttgtatcgcccgctggacagcaactgggcgtttggtctggatgccaactacgttaaacagcgcgactggcgtagtgcaaaagatatgatgaaattcaccgactacagcgtgaaaaccggacatctgaccgcctactggacgccatctttcgctcaggatgtgttagttaaagccagcgtcgggcagtatctggcaggggataaaggcggcacgctggagatcgccaaacgctttgatagcggcgtggtggtgggtggctatgccacgatcactaatgtttcgaaagaggagtacggcgaaggggacttcaccaaaggcgtgtatgtctcggtaccgttggatctcttctcgtctggcccgacacgcagccgtgcggcgattggctggacgccgctgacgcgtgacggtggtcagcaacttgggcgtaagttccagttgtatgacatgaccagcgaccgtagcgtcaatttccgctaagtcatgggaaaggtgccagttttcgcactcactggcaccttcattcttaatggcctgtcgagccatcaggaacgcagttcactcccggtttgcgatctggtgtgtaaaggcgaaaacattctgtcttcctgtccgtcgatatcggttgcaggtctggttgcctgagcgactgggccatcattgggctggagacattgctttgcggtaggtcggctttatcagcagtaccgagcggaccagcataagcaggaagaacagagactgataacatcaaagcagcaaaataaggcttcatttttaccacctttatcaggttacgtttcatttgttccagaggaacattgtcgatttttcgcgcattgctggtggctgggaatcacctgaatgggtgatttttgaattaccggctttggtgcggtttgtcttgccggatgcgccgccaggcgcggcttatccggcctacgggtaggtatatccggctttggtggaggcgcgctccaaatccaggttgaacaaaacatacacaaaaaatatagatctccgtcacatttttgcgttatacaggaagctcgccactgtgaaggaggtactgctatgacgtcactctctcgtccgcgcgtggagtttatctccaccattttgcagaccgtactcaatcttggcctgctgtgcctcggcctgattttggttgtcttcctcggcaaagaaacggtgcatctggctgatgtgctgttcgcgccagaacaaaccagcaaatatgagctggtagaaggactggtggtttactttctctatttcgaatttatcgcgctgattgtgaagtactttcagtccggttttcacttcccgctacgttactttgtctatattgggatcaccgccattgtgcgcttgatcatcgtcgatcataaatcgccactggatgtgttgatctactcggctgcgatcctgttactggtgatcaccctgtggctgtgtaattcgaaacggctgaagcgggagtaaaaagtcagcacgccgaaatggcgcggcgtgctggacaggaagattacagcgtagcagtttgttgtgttttcttcgtttccggttcccagagcgcttccagctcctcaagggttttacctttggtttccgggacaaatttccacataaacagtgctgccagaacgcccatacaaccgtaaatccagtaggagaaaccgttgtggaaatgggccaccagccaggagtttttgtccatcatcgggaaggtccaggagacgaagtagttcgccagccactgggccgccaccgcgattgccagcgctttaccacgaatagcattcgggaagatttccgacagcagtacccagcataccggaccccaggacatggcaaaggcggcaacatagaacagcatcgacagtagcgccacaatacccggtgcctgagtgtaaaacgcggtaccgaggctaaacataccgattgccattccgagtgcgccgataatttgcagtggcttacgaccaaatttatccaccgtcataattgccagaacggtgaaggtgaggttgataactccgacaataatggtctgcaacagcgcgatatccgtgctggcccccagcgttttgaacacttccggcgcgtagtacagcaccacattgatgccgacaaattgctggaagatggagagcattacgccgattacaatcacgcccacgccaaacatcagcagacgaccaccggttttgcggccatgatccagggagtgtttaatttcctgtactgcctgagttgcaagcgtgttgcccataattttgcgcaggataccttccgcctgttcttgcttgccgcgcgacatcagccagcgaggactttctggcacggtatacagcagcattaagaacagcagtgcagggatacattccgaggcaaacatataacgccagccgtcagtattcagccagctggcatcaccggaacgggcaataaaatagtttacgcagtaaactaaaagttgcccgaaaataatcgcaaactggttaaaagagaccagtttcccgcgaatatgagctggagccagttccgcaatatacattggcgagagcattgaggctaaaccaacgccaataccgccaataatgcgataaataacaaattccgggacataacctgccagataaacaggcacagtgttgtccgggtttatagaggtaaaaccaagttctggccaggcagaacctacaccagaaataaaaaacaggacagcagcaatcttaagtgaatcacgacgaccgaagcggttactgcaataaccaccgagggcaccgccgatgatgcaaccaatcagagcgctggccacgcaaaaccctaacagggagttggcagcggattcacttaagttttgtggagcaacaaagacggtattgagtgactcaacagtaccggaaataacggcggtgtcgtagccaaataataaaccacctaatgtagcgactaaggtaatcgaaaatatataactggaattatactgggtattcattcagacctgccttagaccattctgatcttttatcagtgcattgatgttggaattgtcaggcagttaaggcaattatcattttttacaatgcgtttacgtaatgtcttttctgtgatcttaattgtgataattatccaaaattgataaaaacaatactattgccgtgactcagagcacgaaagagaattatcgtaagtgggaaaacaaataacgtaaaaataataagctctatgatggaaatattaaccggcgaacgattcagattgcagacgaaagaaaaaaaggcgctccgtggagcgccgaataacagtcacaagttgggataacgtaagttgagggtgcagcggcataacattggcagaacaacatctttaacctttcacaccacctgccgtcaggccgttgaccagccagcgttgagccagcaagaagacgatggtgatcggtaatgcagacatcacggcagcggcggcaaagtcaccccacaggtagttttgcgggttgaggtattgctgcatccccacggccagggtgtagctgtttacgtcacgcagtaacagcgacgcgaccggaacttcagtaatggcagcgataaacgacaggatgaataccaccgccagaatcggtactgacagcggcaacaggacaaggcggaaggcctgccacggtgtcgcaccatccagcgcagcagcttcttccagcgaactgtcgatggtttcgaaatagcctttgatggtccagacatgcagcgcaatcccacccagatacgcgaaaattacgccgccgtgagtattcaggccaatgaatggaatgtactcacccagacgatcaaacaacgcatacaacgcgaccagtgaaagtactgccgggaacatctggaaaatcagcattcctttcagcagcgtcgctttgcctggaaagcgcatacgggcgaaagcgtaggcgcaggtggtggagagcgccacaatgccaatcgcggaaatcccggcgacctttaccgagttccacagccacagcagtaccgggaatggcggtggcgtaatgcgaccatcagcctgttcaacgctaaaacctaacgccagtttccagtgatcccaggagatttgctccgggatcaggctgccggtcgcaaagtttccctgacgcagcgagatagcgacgaccatcagcagcgggaacataatcgctgcgataaaaagtagcagtagcaggtgagtaataaataaacgagctttttgcgatttcggttggaccattgccatttttgttatctcccttaatcaaacttcattcgcgtggctttcaggttcactatcgccagcgcacccaccagcaggaagatcagcgtggcaattgctgccgccagaccgaagtcctgacccccgccgccttcaaaagcgatgcggtaggtgtagttaacaagcaggtcggtataaccggctggcgtggtcgtgccaagacgatccgggccgccgttggttaacagttgaatcagcacgaagttgttaaagttaaaggcgaagctggcgatcatcagcggcgtcagcggtttaatcagcagcggcagcgtaatcttaaagaagttctggaacggacctgcgccatccattgctgaggcttcatacaaatcgtccggaatcgctttcagcaagcccatgcagaggatcatcatgtacggataacccagccaggtattgacgataattagcatcgtgcgggcggtggtcggatcgctgaaccaggcgggcttcacgccaaacagcgcgctcaacatcatgttgatttcaccgaagctctggttaaacaaccctttgaaaatcaagattgaaatgaacgatggcaccgcgtagggcagaatcagcaggacgcgatagaccgctttgccgcgcaacgcttcccactgcaccagacacgccagaaccatgccgaccgccaccgttaaaaagacagtgatcagcgagaacaccacggtccagacgaaaatggcgaggaacggtttctgaatgccttcgtcggtaaagacgcgggtaaagtttttccagccggtggtcacggtgtaaccggggcttagcttttcatcaccccagttgccgtcggcggtaatggactggtaaaagccaatttggttattcggacgatatttcacgccgctctgattattcgtcaacgtgccgtcaccgtcgagtgtgtagagcggctgcgtgccagaaaactggcgcagggagctcatcatcactttgttgccatccggcagaatggcggtaatgtcactcagcgcctgacgattctgggtaatcacgcgcagattcgcgcgttcgccttcgggctgggcggtcgtttctttcagttgcagtttttgctcgccgccaaatttaaaagcgtcggagaggtaatttttgccggtttcgccgtcgctgagcgccagttgccactcatcgcccgccgggtaaagaccaaagttataggttttgcctgcttgccaggagcgatctaacaacacttcctgcgcacgttcaaaagtcagctggttagtgctgctgtagttggtgaaggcaatggcgatggtgcagaccagagggaagaggacgaataatcccattccagccattcccgggtaaacatagcgccaggcgtaggctttacgattggcgaaaatatacagccccgctgaactcaatatcagcgtggtaatggcgaacaggtattccccttgtgcgtacattaaaacaacaaggtaacccaccagcaggccgagcagacctagcactgaccatttcagcgcgtcgctttgccaccaatgtttctttttaatgacatccatggggttcttcctcattccaggacggataaggctttcacgccttatccgacaacaactgcctgatgcgacgctgacgcgtcttatcaggcctacatacgtttcggttttgtaggccggacaaggcgttcacgccgcatccggcatttcacagcattacttggtgatacgagtctgcgcgtctttcagggcttcatcgacagtctgacgaccgctggcggcgttgatcaccgcagtacgcacggcataccagaaagcggacatctgcgggatgttcggcatgatttcacctttctgggcgttttccatggtggcggcaatacgtggatctttcgccaactcttcctcgtaagacttcagcgctacggcacccagcggtttgtctttattaaccgcttccagaccttcatcagtcagcagatagttttcgaggaactctttcgccagctctttgttcggactggcggcgttaatacctgcgctcagcacgccaacgaacggtttggatggttgacccttgaaggtcggcagtaccgttacaccataattcactttgctggtgtcgatgttggaccatgcccacgggccgttgatggtcatcgctgtttcgcctttattaaaggcagcttctgcgatggagtaatcggtgtctgcattcatgtgtttgtttttaatcaggtcaaccaggaaggtcagacccgctttcgcgccagcgttatccacgcccacgtctttaatgtcgtacttgccgttttcatacttgaacgcataacccccgtcagcagcaatcagcggccaggtgaagtacggttcttgcaggttgaacatcagcgcgctcttacctttcgctttcagttctttatccagcgccgggatctcttcccaggtttttggcgggttcggcagcagatctttgttataaatcagcgataacgcttcaacagcgatcgggtaagcaatcagcttgccgttgtaacgtacggcatcccaggtaaacggatacagcttgtcctggaacgctttgtccggggtgatttcagccaacaggccagattgagcgtagccaccaaagcggtcgtgtgcccagaagataatgtcagggccatcgccagttgccgcaacctgtgggaatttctcttccagtttatccggatgctcaacggtgactttaattccggtatctttctcgaatttcttaccgacttcagcgagaccgttatagcctttatcgccgttaatccagattaccagtttaccttcttcgattttggcgagagccgaggcggaaaacatcatcgtcgttaatgcggataatgcgaggatgcgtgcacctgtttttattttcataatctatggtccttgttggtgaagtgctcgtgaaaacacctaaacggactctagtttctttatacggcaacctctttccatcctccttgcccctacgccccaccgtcgctttgtgtgatctctgttacagaattggcggtaatgtggagatgcgcacataaaatcgccacgatttttgcaagcaacatcacgaaattccttacatgacctcggtttagttcacagaagccgtgttctcatcctcccgcctcctcccccataaaaaagccagggggtggaggatttaagccatctcctgatgacgcatagtcagcccatcatgaatgttgctgtcgatgacaggttgttacaaagggagaagggcatggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaaacggatgaatgacactccgccagcagaacgcggcgttggtatggtgtttcagtcttacgcgctctatccccacctgtcagtagcagaaaacatgtcatttggcctgaaactggctggcgcaaaaaaagaggtgattaaccaacgcgttaaccaggtggcggaagtgctacaactggcgcatttgctggatcgcaaaccgaaagcgctctccggtggtcagcgtcagcgtgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgccggtcgcgtggcgcaggttgggaaaccgctggagctgtaccactatccggcagaccgttttgtcgccggatttatcggttcgccaaagatgaacttcctgccggtaaaagtgaccgccaccgcaatcgatcaagtgcaggtggagctgccgatgccaaatcgtcagcaagtctggctgccagttgaaagccgtgatgtccaggttggagccaatatgtcgctgggtattcgcccggaacatctactgccgagtgatatcgctgacgtcatccttgagggtgaagttcaggtcgtcgagcaactcggcaacgaaactcaaatccatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaagcaccccacaaaacacacaaagcctgtcacaggtgatgtgaaaaaagaaaagcaatgactcaggagatagaatgatgattactctgcgcaaacttcctctggcggttgccgtcgcagcgggcgtaatgtctgctcaggcaatggctgttgatttccacggctatgcacgttccggtattggttggacaggtagcggcggtgaacaacagtgtttccagactaccggtgctcaaagtaaataccgtcttggcaacgaatgtgaaacttatgctgaattaaaattgggtcaggaagtgtggaaagagggcgataagagcttctatttcgacactaacgtggcctattccgtcgcacaacagaatgactgggaagctaccgatccggccttccgtgaagcaaacgtgcagggtaaaaacctgatcgaatggctgccaggctccaccatctgggcaggtaagcgcttctaccaacgtcatgacgttcatatgatcgacttctactactgggatatttctggtcctggtgccggtctggaaaacatcgatgttggcttcggtaaactctctctggcagcaacccgctcctctgaagctggtggttcttcctctttcgccagcaacaatatttatgactataccaacgaaaccgcgaacgacgttttcgatgtgcgtttagcgcagatggaaatcaacccgggcggcacattagaactgggtgtcgactacggtcgtgccaacttgcgtgataactatcgtctggttgatggcgcatcgaaagacggctggttattcactgctgaacatactcagagtgtcctgaagggctttaacaagtttgttgttcagtacgctactgactcgatgacctcgcagggtaaagggctgtcgcagggttctggcgttgcatttgataacgaaaaatttgcctacaatatcaacaacaacggtcacatgctgcgtatcctcgaccacggtgcgatctccatgggcgacaactgggacatgatgtacgtgggtatgtaccaggatatcaactgggataacgacaacggcaccaagtggtggaccgtcggtattcgcccgatgtacaagtggacgccaatcatgagcaccgtgatggaaatcggctacgacaacgtcgaatcccagcgcaccggcgacaagaacaatcagtacaaaattaccctcgcacaacaatggcaggctggcgacagcatctggtcacgcccggctattcgtgtcttcgcaacctacgccaagtgggatgagaaatggggttacgactacaccggtaacgctgataacaacgcgaacttcggcaaagccgttcctgctgatttcaacggcggcagcttcggtcgtggcgacagcgacgagtggaccttcggtgcccagatggaaatctggtggtaatagcaaaacctgggccggataaggcgtttacgccgcattcggcaaccaacgcctgatgcgacgcttgcgcgtcttatcaggcctacaacggctgtcaaatgtaggccggataaggcgtttacgccgcatccggcataaaaacaggttgtcattatctgaaaggggcgaaagcccctctgattatcgggtttagcgcgctattgcctggctaccgctgagctccagattttgaggtgaaaacaatgaaaatgaataaaagtctcatcgtcctctgtttatcagcagggttactggcaagcgcgcctggaattagccttgccgatgttaactacgtaccgcaaaacaccagcgacgcgccagccattccatctgctgcgctgcaacaactcacctggacaccggtcgatcaatctaaaacccagaccacccaactggcgaccggcggccaacaactgaacgttcccggcatcagtggtccggttgctgcgtacagcgtcccggcaaacattggcgaactgaccctgacgctgaccagcgaagtgaacaaacaaaccagcgtttttgcgccgaacgtgctgattcttgatcagaacatgaccccatcagccttcttccccagcagttatttcacctaccaggaaccaggcgtgatgagtgcagatcggctggaaggcgttatgcgcctgacaccggcgttggggcagcaaaaactttatgttctggtctttaccacggaaaaagatctccagcagacgacccaactgctcgacccggctaaagcctatgccaagggcgtcggtaactcgatcccggatatccccgatccggttgctcgtcataccaccgatggcttactgaaactgaaagtgaaaacgaactccagctccagcgtgttggtaggacctttatttggttcttccgctccagctccggttacggtaggtaacacggcggcaccagctgtggctgcacccgctccggcaccggtgaagaaaagcgagccgatgctcaacgacacggaaagttattttaataccgcgatcaaaaacgctgtcgcgaaaggtgatgttgataaggcgttaaaactgcttgatgaagctgaacgcctgggatcgacatctgcccgttccacctttatcagcagtgtaaaaggcaaggggtaattacgccccacagtgctgattttgcaacaactggtgcgtctcctggcgcacctttttttatgcttccttcctgggatatgagcgattttttatagtaactcacttcttcttcactaagaatatccattatctcaatgccttatcagagattcttttcctttcgccggtagtgtctggacattcaggctacttttccaggttattttatttctgttatgcagaggttttatgataagtcatatcctaaattctggcggcaataactctttgatgaaacatgatgtggtgcaaggaaataatatagtagatcttgatttactacgtaatttaaatggggtgccaggtttaaacagagataactttatttatatcagcaatattttttcaaatataaaacaacggaacgaaaaaatcatgcaataaatatgtttcgtgaagtctcaatcagtaatgatactataagtgtaaaattctacagaaatgaaaaaaattgaatgcgcttgcaattttctgatggataaagatgcgcaggggtatatcgacctgtctgatttggatttaacaagttgtcattttaaaggtgacgttatatcgaaggtgtcttttttatcatcaaatctacaacatgtaacattcgaatgtaaagaaattggggattgcaattttactactgcaatagttgataatgtcatatttagatgtcgacgtttacacaatgtgatttttatcaaagcgagtggtgaatgtgtcgatttcagcaaaaatattcttgatacagttgacttctcgcagagtcaacttggtcatagtaattttcgcgaatgtcagattagaaattcaaacttcgataattgttatctttacgcttcgcacttcaccagagcagagtttctgtctgccaaagaaatatcatttattaaatcgaatttgacagctgttatgtttgattatgtgcgaatgtcgacagggaattttaaagattgcattacagaacaattggaattaactattgattattcagatatattttggaatgaagatctcgatggttatatcaataacattataaaaatgattgatacattgccagataatgcaatgatattgaaatccgttctggccgtaaaactggtgatgcaattaaaaatacttaatattgttaataaaaactttattgagaatatgaagaaaatatttagccattgtccttatataaaagatcccattatacgcagttatatccattctgatgaagataacaagttcgatgattttatgcgtcaacatcgattcagtgaggtgaatttcgatacccaacagatgatcgattttattaacagatttaatacgaataaatggctaattgataaaaataacaatttttttatccaacttatcgatcaggccttacgatcaacggatgatatgatcaaagcaaatgtttggcatctttataaagagtggattcgtagtgatgatgtttcacctatatttatagaaactgaagataatttaagaacctttaacacgaatgaattaacacgaaacgataatatctttatcctgttctcctcagtcgatgatgggccagttatggtggtaagctcccagcgcttacatgatatgttgaatcctacaaaagataccaattggaattccacgtatatctacaaatccagacatgagatgttgcctgttaatcttactcaggaaacacttttcagctccaaatctcatggtaaatatgcgcttttccccatttttactgcgagttggcgagctcatcgtataatgaataagggtgtttaagtaaaggaaaacatcaccgttcctggcatcctggacggtgatgcccctacggttgccctcgccagcacgggcatcggtaaagcgtaaggttcaacatcgttttaccacttcatgcgattgttgcgtttttgttgcgtattagatcacttaatttgctttacatctcccgtaaacacttttctgcgatacaatgcctttacgttatgtaacggagagttcggcatgtcacaccccgcgttaacgcaactgcgtgcgctgcgctattgtaaagagatccctgccctggatccgcaactgctcgactggctgttgctggaggattccatgacaaaacgttttgaacagcagggaaaaacggtaagcgtgacgatgatccgcgaagggtttgtcgagcagaatgaaatccccgaagaactgccgctgctgccgaaagagtctcgttactggttacgtgaaattttgttatgtgccgatggtgaaccgtggcttgccggtcgtaccgtcgttcctgtgtcaacgttaagcgggccggagctggcgttacaaaaattgggtaaaacgccgttaggacgctatctgttcacatcatcgacattaacccgggactttattgagataggccgtgatgccgggctgtgggggcgacgttcccgcctgcgattaagcggtaaaccgctgttgctaacagaactgtttttaccggcgtcaccgttgtactaagaggaaaaaaatatggagtggagtctgacgcagaataagctgctggcgtttcatcgcttaatgcgtacggataagccaattggcgcgttactgctgctctggccaacattatgggcgttgtgggtggcgacaccgggcgttccccagctctggatcctggcggtgtttgtcgcgggtgtctggctgatgcgcgctgccggatgtgtggtgaatgattatgctgaccgcaagtttgatggtcatgttaagcgcacggcgaaccgaccacttcccagcggcgcggtaacagagaaagaggcgcgcgcgctgtttgtcgtgctggtactgatttcgtttttactggtgctgacgctgaatacgatgaccattctgttgtcgattgccgcgctagcgctggcgtgggtgtacccgtttatgaagcggtatacccatctaccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccacggcaatcctgttcggccaatacgataaattgattattggtattttgcagattggcgtactggcactgatggcgatcatcggtgagttaaatggcttaggctggggatattactggtcaattctggtggctggcgcgctgtttgtttatcaacaaaaactgattgccaaccgcgagcgtgaagcctgctttaaagcatttatgaataataactatgttggtctggtactatttttagggctggcaatgagttactggcatttctgatgatgtaaaaaagccggatgatcatccggctttcttctgggttgcctgatgcgcggcgcttctcaggcctacacaacacatcgcaatttattgaatttgcagattatggaaggccggataaggcgttttcgccgcatccggcaattctctctgattacccttcgccctgcgtcgcactctcaatcgtcaaacgcacgtctgatgtaatcaactccgccagcaactgataaaccttcatcgtttctgccggttcggcatcgccgctatcgctgatatacccttcatcacgcagtgtcagcaccagagaactgaacaccgccttgtcgaagaactccggcgcgttgatgccgtgcagcacggagagacgttgcgcgacggtgcggctctctttctccagcgtaccgcggttgatcgacgggttggcactcaacaaccagaaggtgatggcataacgttgcagcgtttcgcgcgcgcctgcggccagcagctgtagcgtgcgagaatgcgccgggttgatatgcaactcatcatcttgcagggtaatcagcccctgacgttgcatctcatttgccagcgcatcaataacgtccggcaactcgtcgcgatcccagcgcaggaacagctccgctttcagcattgggtaaagcacattgacgtgctccatcaatacgtcgcgggagatgtggcgatgctgggtgacgattgccgccatcagcgaaggcagcaccaacatatgcgcaatgttgttgcgatagtaggtcatcagcaccgcttgctcgcgcggcagaatgatgatgtcgccgattgtgtctttctcgacttcaaacttgttcatttgcagcgcgtgatcgataagctcgctggcgctggctgaaggaacggtagagtccgtggagtagggcacgttgcgcatcagatccaggtagcagttgagttgctcggttaactgctcgcgggtgagtgagcgctgacgtgatgccagtagcgcagtacagcacaggttcatggcgtttgccgcgcctgcgttgttaatgcgtaccatcagatcggcagcaatattattgaccgtcggcgttaaccatgccggacgcaccgcttcgatgggatcgatagattcacgccagtcaggtacatgctggttaaggtaggtcatcaacggcattggttcaccgaagttgacgtaaccctgaccgagattacgcagcttgcttaaaccgcgcagcatctgcggcaggctctctttctctttcgtcgcgccgcgcagttctttggcgtaagtacccacttccatgacgtgctcataaccgatatagatcggaatcagcgtaatcggacgcgtgccgccacgcagcatcgcctgaatggtcatcgacagcgtaccagttttcggatccagcaaacgccccgtacgggaacgaccgccttccacgaagtactcgacggaataaccacggctgaacagttcgccgagatactcccggaaaacggtggaataaagtttattgcctttaaacgtacggcgaataaagaacgcccccagacggcggaaaatcggcccggcaggccagaaattcaggttgatcccggcggcgatatgcggcggcaccagcccctggtgatacagcacgtaagaaagcagcaggtagtccatgtgactgcggtggcaaggcacatataccagctcatgaccgtcgtgggccagctggcgaacgcgctcagcgttatggacgttgatgccctggtaaagtcggttccaggtgaagcccagaatacggtcagtcaggcgaatcatctcgtaagagaaattcgccgcaatctcttccatcagtgcaatcgcgttctgctgcgctttttcatgggagatttttttgctgcgcgcttcatcttctaccgctttggcaatggcgcgggaggcgagcagcttattaaacagatcctgacgagcaggcaaacgtgggcctacggcagccagacgttgacgggcaaagtgcatacgcgccacgcgcgccagtttctgagcgatagttttatccgtgccgtgttcatccgccatacggcgcagcgaaactgacggcgagaaacgcacaaaactgtcgcgaccgagccacagtacagcgaaaaatttctgtacgccgttaagcatacgcagcggcgggttcacttcgcctttttcacgccccggcgcgcgaccaaacatcaccgacactggcaccatctgcacatccagatttgggttgctacggtgcaaatcgagatagtcgtggaacagcttaatagactcttctttcggcgtgtaataggtgaacacacgcggcccgccgtgaatgaacacatagcgcggcagtagcgtgccgtcgatttccagcggctctaacgggtcaggcaagtcatgtgccagacactgggcgcgcaacgtcagcaaatctgctttcgagttgtacggtaaaacgtacataattggacgagaggtatccagccccagttccggggcaggatctgccggaatagacttgctttttaccaggatgcttaatggtaaattcagtaatttgtagtaaattcgtggccagccggacataaacgatgtaaagcctctggttaataatgcaaatgcgcggcaaggatagcagaaagtcatgggaaattctgtggtatccgctcatgtttcgcgcggcgctacgcaaacccgaatcatcggatttaacggtacactgatattgacgctcataatgtaaaaaggttctttcaatggccaataataccactggattcacccgaattatcaaagctgctggctattcctggaaaggtttacgcgctgcatggatcaacgaagcggcattccgtcaggaaggcgtagcggtattgttggcggtggtcatcgcctgctggctggatgtggacgcgattacccgcgtgctgcttatcagctccgtgatgctggtgatgattgtggaaatcctcaatagcgccatcgaagcagtggttgaccgaattggctctgaataccatgagctttccggacgcgcaaaagatatgggatccgctgcggtgctgattgccattatcgtcgccgtgattacctggtgcattctgttatggtcgcattttggataacccttccagaattcgataaatctctggtttattgtgcagtttatggttccaaaatcgccttttgctgtatatactcacagcataactgtatatacacccagggggcggaatgaaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaggaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgttgaccttcgtcagcagagcttcaccattgaagggctggcggttggggttattcgcaacggcgactggctgtaacatatctctgagaccgcgatgccgcctggcgtcgcggtttgtttttcatctctcttcatcaggcttgtctgcatggcattcctcacttcatctgataaagcactctggcatctcgccttacccatgattttctccaatatcaccgttccgttgctgggactggtcgatacggcggtaattggtcatcttgatagcccggtttatttgggcggcgtggcggttggtgcaacggcgaccagctttctctttatgctgttgctgtttttacgcatgagcaccaccgggctgactgcgcaggcttatggtgccaaaaatcctcaggcattagcccgtacgctggtgcaaccgttgctgttggcgttgggggctggggcgttaattgcgctgctgcgtacgccgattatcgatctggcgctgcatattgttggcggtagtgaggcagtcctggaacaggcgcggcgctttcttgaaatccgctggttaagcgcaccggcgtcgctggcgaatctggtattactcggttggttactcggcgtgcaatatgcccgtgcgccagtaattttgttagtggtcggcaatatcctcaacattgtgctggatgtctggctggtgatggggctgcatatgaacgtgcagggcgcggcgctggcgacggttattgcggaatatgcaacattgctgattggtctgctaatggtgcgtaaaatcctcaaactacgcggaatttccggcgaaatgctgaaaactgcctggcgaggaaacttccgtcgcttgctggcgcttaaccgcgatatcatgctgcgttcgctgttgttgcaactctgtttcggcgcgatcaccgtacttggcgcgcgactggggagtgacattatcgctgttaacgcggttctgatgacgctactcacctttaccgcctatgcgctggatggttttgcctacgcggttgaagcgcactccggtcaggcatacggtgcgcgcgacggtagccagttgctggatgtctggcgggcagcgtgccgccagtcggggatcgtagcgttactgttttcggtggtttatttgctggctggggaacacatcattgcgttactgacgtcgttaacccagattcagcagctggctgaccgctatcttatctggcaggtgattttgccggtggttggcgtctggtgttatctgctggacggcatgtttataggcgcaacgcgtgccaccgaaatgcgtaacagtatggcggtggccgccgcaggttttgcgctgacgctccttacgctgccgtggctgggtaatcatgctttgtggctggcattaaccgtctttctggcgttgcgcgggctttctctggcggctatctggcggcgtcactggcgcaatggtacctggtttgccgcaacgtgacggttaaaaattctgaataaataatcctaagccaaattgctgactacacttaatctcacgttcagaagaaaagtgaacgtactctcattcacaacctaacgatgaggtcttgattatgaataaagatgaagccggcggtaactggaaacagtttaaaggtaaagtgaaagagcaatggggcaaactgaccgatgatgatatgacgatcattgaaggtaaacgtgatcaactggtcggtaaaatccaggaacgttatggttatcagaaagatcaggcagaaaaagaggtcgtggattgggaaacccgcaatgaatatcgctggtaattaatccctcctgcccgacgtgtacaaggatgtacgccctcttaacgcggtttctttttcacctgcacagagtgatcatgctggcactgttcaggatgacgacacgcttccacttctacacatgccgcacagagcccatgtgcttcaatcacattatgccgcagggcaaaccccatttttgccgccagcgtatgcataatgtcttccacgccttctgcacactcttctttcactgcgccgcagcgatcgcaaataaacatggctgacgtatgggtgggctgatcgaacagatgacagagcacataactgttggtggattccaccttatgcacaaaaccttgctcaagcagaaaatccagcgcgcgataaaccgttggcggcttggcttgcggttcagcttcgcgcagtaaatcaagcagatcataagcgctgatagcgccatcctgcagactcatcaggcgcaacacttccaggcgctgtggggtcaggcgcacattacgctgcgcgcagattttttcagcctgcgctaataactcctgcgttgtggtcttttccatcgggcacctcaaagtgggggttaagaatgtccttactttaccatgttccaggaaaaacaccgagaacccttattgttgccgtaatgttgattttctgttttgtaggtaaggtgttatgttgccttgtcgtaccattatcaacacgataataattaataattcatttttaaataaattgcttcaagttaactcgctatttatttaactgggtttaaacgcatacctgtagttcagaaattatgagcgatttttgatagtgaccagatggcaaaagaattataaggaggacacggtacgacaaaaaaggtagatgaatcatgttgaagataatacccggtgcaactggatactttaataaaacactcaattcaaatcaattcgataatgaagatgcaatcaaagataaattagataatagaggttcaatcaaaggtaaattaaataatatatatggtaaatctattgattatgcagcgctgcgtcatcgggatataattattgcaaaaatagatttgtttattcaacgaatcacgcataatttatggcatgcacgtaaaaaaatgtgtttttaattgtgcaaataaatgatctcaaaatgtgggtcaataagtatattgacgattgcactgatgaggatttaaacgatcgtgactttattgcatcagttgttgaccgggctatttttcatttcgcgattaatagtatatgtaatcctggggataataaagatgcaatgcccattgaacaatgtacttttgatgtagaaactaagaatgaccttccctccacggttcagctattttatgaggaatctaaggataatgaacctttagcgaatatacattttcaagcaataggttctggttttttaacgtttgttaatgcctgccaggaacatgatgacaacagcttaaaattatttgcttcgctgttaatttcactttcatattctagtgcctacgcagatttatcagaaacagtgtatattaatgaaaataatgagagctacctgaaagctcagtttgaaaaattatctcaacgtgatatgaagaagtacctgggagagatgaagcgtctggctgatgggggagaaatgaattttgatggctatctggataagatgtcacatctggtgaatgaaggaacgctcgatcctgatattttaagcaaaatgcgagatgctgcaccacaattaattagcttcgcgaagtcgtttgacccaacctcaaaggaagagattaaaatacttacagacacttctaaattaatttatgatttgttcggggttaaatcggagaaataatatgtgaagttcttcgatagtatggaaggcattatataaaaggacccaatatttattgggttcttttttctctatcaatactattagcagggagatatatcaccagagtttaatgtgtgattttttatttatcgtcgaacctggattgtttatcattggccttaacaaagttaacggctaataagattatttccatcacttcgtgagagcttcatgccttgagaggatctcaattttcttttgcaatgagacaggcgcttcctgttgttatggtatagtaccccgctattgagcctcctgaatagtgatgctgaataacataaccccatgatatatcgataaaataatctctacatttgaaaatgcacggtaattctgaaatgcaaaaaatcaaccaaaccagcgcaatgcctgaaaaaactgacgttcactggagtggtcggtttagcgttgcaccaatgctcgactggacggacagacattgccgctatttcttgcgtctgctttcccgcaatacgttgctgtataccgaaatggtgaccacaggggcgattattcacggtaaaggtgattatctggcgtacagtgaagaagaacatccggtagcgttgcaactgggcggtagcgatccggcggcgctggcgcagtgtgcaaagctggcagaagcgcgcggatatgatgagatcaacctgaatgtcggctgcccgtctgaccgggtgcagaacggcatgtttggtgcgtgtctgatgggtaatgcgcagctggttgccgactgcgtgaaagcgatgcgcgatgtggtgtcgattccggtgacggtgaaaacgcgtattggcatcgacgaccaggacagctatgaatttctctgcgatttcatcaataccgtttccggcaaaggcgagtgtgagatgttcatcatccacgcacgtaaagcctggctttcggggttaagcccgaaagaaaaccgtgaaatcccgccgctcgattatccgcgtgtgtatcaactgaagcgtgactttccgcatctgacaatgtcgattaacggtggtatcaagtcgctggaagaggccaaagcacacctgcaacatatggatggcgtgatggtcgggcgcgaggcgtatcagaatccgggtattctggcggcggtagaccgggagatctttggttcctcggataccgatgccgatccggtggcggtagtgcgcgccatgtatccgtacattgagcgtgaactcagccaggggacgtatctcggccatattacccggcatatgttgggcttgttccagggtattcctggcgcgcggcagtggcggcgttatttaagtgaaaatgcccataaagcgggtgcagacattaatgtgctggaacacgcgctcaaactggtggcggataagcgttaacttttcaccaaaaagtagtcaaattcaccacgccctgcgcaccgtcgcggggcgttttgctgttaaatcaatagattatttttggcatgattcttgtaatgccagcaagagatttcatatttgggagagcatcatgctggaactactttttgtgattggcttttttgtcatgctgatggtcaccggcgtttcgttgctgggcattatcgccgcgctggttgtggcgacggccattatgttcctcggcggtatgctggcattgatgattaagttgctgccgtggttactactggcgattgcggtggtgtgggttattaaggcgattaaagcaccaaaagtgccgaaatatcagcgttatgaccgctggcgttactaagggattgtgcggatgatcacaacctaaggttttatccttagaacaaaataggaattgataatcaaatctgtcactattgcgcctctaacagattcatcgtgctgtaccctacatacagccgaactataaaaagaaagggcttcccaggtggaagccctatttcttttatggaatcagcaggctggaaccttgcgtcgcccggctttccagaatctcatgcgcacgctgcgcatccttcagcggatatttctgctgctcggcgacatcgaccttaatcacaccgctggcaatcaaagagaacagttcattactggcctcggttaattcctcccgcgtggtgatatagccttgcagggaagggcgtgtcacatacaacgagcctttttgattgagaatgcctaagttcacaccggtaaccgcacctgatgagttgccaaaactgaccattaagccgcggcgttgcaggcaatccagcgaccgttcccaggtgtctctgcccacggaatcgtacaccacgcgcactttcttaccgccggtgatctcttttaaccgctcgaccagatcctcttcacgatagttaataacctgccacgcgcccgcttttagcgcgctctgcgctttttgcgcggttcctacggtgccgataagtttcgcgcccagggcttttgcccactggcaggcaattaagccaacgccgccagccgctgcgtggaacaggaactgttcatcgggtttaatttcataggttttgcgcagcagataataaaccgttaagcctttcaggaaggatgccgcagcttgctcaaaagaaattgccgcaggcagaatcgccgctttatccgcaataatgttatgcacagagctgtaagcgcctaacgccgactgcgcatagactacacgatcgcctgccttaatatgctttacaccactgccgactttactcacgatgcctgctgcttcggtgcctaatccgctgggtagcgatggcggcgggtaaaggccgctgcggatatatgtgtcgataaaattgatgccgatggctttattttcgacctggatttcattctccgccggatcggcaggagtgaactctacggcttgaagtacttccgggccaccgtgcttgtgaaattcaattcgtgttgccatgtgtcctccagaacgtatcgtcagggtctgcttcatatgataaagtttcgacccattctttatctcggtaactccattcactatggcaggaaataaacccttcaacaaacagcaggctgaaccccgcgaacgcgatccacaagttgccgggctgaaagtgcctccgcactcgatcgaagcggagcagtcggtgttgggcggtttaatgctagataacgaacgctgggatgatgtagccgagcgtgtggtagcagacgatttttacacccgcccacaccgtcatatctttactgaaatggcgcgtttgcaggaaagcggtagccctatcgatctgattactcttgcggaatcgctggaacgccaggggcaactcgatagcgtcggtggttttgcttatctggcagagctgtcaaaaaatacgccaagtgcggctaacatcagtgcctatgcggacatcgtgcgtgaacgtgccgttgtccgtgagatgatctcggttgcgaatgagattgccgaagctggttttgatccgcaggggcgtaccagcgaagatctgctggatctggctgaatcccgcgtctttaaaattgccgaaagtcgtgcgaacaaagacgaagggccgaagaacatcgccgatgtgctcgacgcaaccgtggcgcgtattgagcagttgtttcagcagccacacgatggcgttaccggggtaaacaccggttatgacgatctcaacaaaaaaaccgctggcttgcagccgtcggatttgatcatcgtcgccgcgcgtccgtcgatgggtaaaacaacatttgcgatgaacctcgtcgaaaacgcggcgatgttgcaggataaaccggtacttatcttctcgctggagatgccatcagaacagatcatgatgcgttctctggcgtcgctgtcgcgcgttgaccagactaaaatccgtaccgggcagctcgatgacgaagactgggcgcgcatttccggcaccatgggtattttgctcgaaaaacgcaatatctatatcgatgactcctccggcctgacgccaacggaagtgcgttcccgcgcacgccgtattgcccgtgaacacggcggcatcgggcttatcatgatcgactacctgcaactgatgcgcgtaccggcgctttccgataaccgtacgctggaaattgcagaaatctctcgctcgctgaaagcactggcgaaagaactgaacgtgccggtggtggcgctgtcccagttgaaccgttctctggaacaacgtgccgacaaacgcccggtcaactccgacctgcgtgaatctggctctatcgagcaggatgcggacttgatcatgtttatctatcgtgatgaggtgtatcacgaaaacagtgatttaaaaggcatcgcggaaattattatcggtaaacaacgtaacggcccaatcgggacggtacgcctgacctttaacggtcaatggtcgcgcttcgacaactatgcggggccgcagtacgacgacgaataataattattttatgaattaggtaattaaagcaaacacttatcaaggaacacaaatgcaagcggcaactgttgtgattaaccgccgcgctctgcgacacaacctgcaacgtcttcgtgaactggcccctgccagtaaaatggttgcggtggtgaaagcgaacgcttatggtcacggtcttcttgagaccgcgcgaacgctccccgatgctgacgcctttggcgtagcccgtctcgaagaagctctgcgactgcgtgcggggggaatcaccaaacctgtactgttactcgaaggcttttttgatgccagagatctgccgacgatttctgcgcaacattttcataccgccgtgcataacgaagaacagctggctgcgctggaagaggctagcctggacgagccggttaccgtctggatgaaactcgataccggtatgcaccgtctgggcgtaaggccggaacaggctgaggcgttttatcatcgcctgacccagtgcaaaaacgttcgtcagccggtgaatatcgtcagccattttgcgcgcgcggatgaaccaaaatgtggcgcaaccgagaaacaactcgctatctttaataccttttgcgaaggcaaacctggtcaacgttccattgccgcgtcgggtggcattctgctgtggccacagtcgcattttgactgggtgcgcccgggcatcattctttatggcgtctcgccgctggaagatcgctccaccggtgccgattttggctgtcagccagtgatgtcactaacctccagcctgattgccgtgcgtgagcataaagccggagagcctgttggttatggtggaacctgggtaagcgaacgtgatacccgtcttggcgtagtcgcgatgggctatggcgatggttatccgcgcgccgcgccgtccggtacgccagtgctggtgaacggtcgcgaagtaccgattgtcgggcgcgtggcgatggatatgatctgcgtagacttaggtccacaggcgcaggacaaagccggggatccggtcattttatggggcgaaggtttgcccgtagaacgtatcgctgaaatgacgaaagtaagcgcttacgaacttattacgcgcctgacttcaagggtcgcgatgaaatacgtggattaatcgttctgtaatatttgattgtctgtgccggatgcggcgtgaatgccttatccggccaataaaatcctaaaaattcaataagttgatgttctttcatgctcttataaaggtcgtgcctctggcggatgtacgtttgtcatgagtctcactctgttgctaattgccgttcgctcctgaacatccactcgatcttcgccttcttccggtttattgtgttttaaccacctgcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaactgcaagccgtggcggaggcggaagcgcgcctgaatgcgcagcctcatggcgcttcgctttatttaccgatggaagggcttaactgctatcgccatgccattgcgccgctgctgtttggtgcggaccatccggtactgaaacaacagcgcgtagcaaccattcaaacccttggcggctccggggcattgaaagtgggcgcggatttcctgaaacgctacttcccggaatcaggcgtctgggtcagcgatcctacctgggaaaaccacgtagcaatattcgccggggctggattcgaagtgagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttattccattcctcgatattgcctatcaaggatttggtgccggtatggaagaggatgcctacgctattcgcgccattgccagcgctggattacccgctctggtgagcaattcgttctcgaaaattttctccctttacggcgagcgcgtcggcggactttctgttatgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaatgcaggaaagcaggctggagctacccagcctgcagtgaaattaaactgtcgtcgctttcactctttctttatagatgatttttttgatgccatcgttctacgtgagagataataaacgttgttagttcttttattgttaagcttatcccaattatctggaattccttatcctgtttttttgggtggagtaataatttctgcacatctaaccattattaaatttaataataagtatcgggtttgttacgatagaatatttctatatcctcaagaatatgctttgccttattgcctgtgactttctgagattcaattatagtatcgttaaattctaatgttaaagagaactcttttttccgctttgtgtaagtttaaccttatattgattaccaatatcaaataaaaaggtcctgtaatgagaataatcacctttaacctcctcggcaaaacagcaaagcgtgcaaatatacataaagtctttcttacccctgattttgttaactaaatcaataaatgcgtgaaaaactttacttgcaatagaacttgatacttcttctccaggtctaaaaaatcttttgcaatttttaactgtgtttctatgtataaaaagaaatctttggcataagagatatctttattatttagtgcatctagctcaacaggtaaagatgtcgttttgttgctattcacatatgatatattcatatcatcatctccatcgcgagtaataaaattaatcaccattgtagggtagggggctggtcaatcagaaatcatctttataaacttcgattgtttttgtaatgctgtatcattaagttcattaaatcgtacagcagataaatgttctatcaaatttcgctcatttgccgaggattcatcataataaacgtaaaattaatgtatccttacatcgagtaataaacattttttatacaaaaaaagacaggaacgtatttactgggttaaatataatcatcctgcttttcatcacaaaaaccgcagataatccttcctttccccggcagctggcgttatggtcagatggtttttgcaacaaatctcacaataaaaagtttcaacatactgactatttagggaaaaatatgcgcaagatcacacaggcaatcagtgccgtttgcttattgttcgctctaaacagttccgctgttgccctggcctcatctccttcaccgcttaaccctgggactaacgttgccaggcttgctgaacaggcacccattcattgggtttcggtcgcacaaattgaaaatagcctcgcagggcgtccgccaatggcggtggggtttgatatcgatgacacggtacttttttccagtccgggcttctggcgcggcaaaaaaaccttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagcccgacgaaaacagaaacggtttcaaaaacgctggcggataattttcatattcctgccaccaacatgaatccggtgatctttgcgggcgataaaccagggcaaaatacaaaatcgcaatggctgcaggataaaaatatccgaattttttatggcgattctgataatgatattaccgccgcacgcgatgtcggcgctcgtggtatccgcattctgcgcgcctccaactctacctacaaacccttgccacaagcgggtgcgtttggtgaagaggtgatcgtcaattcagaatactgacagagcgggagagcgtgatgctctcccgaatgctgtttttttaatcacacctttatcctttcgctgtcttgctgcaaactgattaagagagttttatcaaggagcagcacatgtggtatcaaaagacgctcacgcttagcgccaaatctcgtgggtttcatctggtaacggatgaaattctgaatcagctggctgatatgccgcgcgttaacatcggcttactgcatctgttgctgcaacatacctccgcctctctgacacttaatgagaactgcgatcccaccgtacgccacgacatggagcgttttttcctccgcaccgttcccgacaacggaaattatgagcatgactatgagggagcagacgatatgccttctcatatcaaatcctcaatgctgggaacatcgcttgtattgccggtgcataaagggcgtattcagaccggcacctggcaaggcatttggctgggggaacatcgcatccacggcggatcgcgtcgcatcatcgcgacactacaaggggagtaaaaaatgaccatttcggagttgctacaatattgcatggcaaaaccaggcgcagaacagagcgtgcataatgactggaaagcgacgcagatcaaagtggaagatgtactgtttgcgatggtgaaagaagtagaaaatcgcccagctgtttcgctgaaaaccagcccggagctggcggagctgctacgtcagcagcacagcgatgtgcgtccaagccgccatctgaataaagcgcactggagcaccgtgtatctcgacggttcgctgccagattcgcaaatctattatctggtggatgcgtcttatcagcaggcggtgaatttactgccggaagaaaaacgtaaattgctggtgcaactctgaaaggaaaaggccgctcagaaagcggccttaacgattacagcatcggcttaaggaagcgtgccgtgtgtgatgcttcgcactccgcgacggtttctggcgtaccggagacgaggatctcgccgccaccactgccgccttctggtcccaggtcgacaatccagtcagcggttttgatcacgtcgagattgtgctcaatcaccacaatggtgttgccctgatcgcgcagtttatgcagtacgtcgagcagttgctgaatatcggcgaagtgcagaccggtggtcggctcgtcgagaatatacagcgtctgcccggtgccgcgttttgacagttcacgcgccagcttcacgcgctgggcttcaccgcctgaaagggtggttgcggactgccccagtcgaatgtacgtcaggccaacgtccatcaacgtttgcagcttacgcgccagtgcaggtacggcatcaaagaactcacgcgcctcttcgatggtcatatccagcacttcgtggatggttttgcctttgtacttaatctccagcgtttcacggttatagcgtttacctttgcactggtcgcacggcacgtagatatccggcaggaagtgcatctccactttgatcacgccatcgccctgacaggcctcgcagcgtccgccacgaacgttaaagctgaaacgtcccggcgtatagccgcgcgcacgggattccggtacgcccgcaaacagttcgcgcacaggcgtaaacacgccggtataggtcgccgggttagaacgtggagtacgaccaattgggctttggtcgatatcgatcactttatcgaaatgctccagcccctgaatatcgcgatacggtgctggttcggcgatggtcgccccattcaactggcgttgggcaatcgggaacagtgtgtcgttaatcagcgtcgatttaccggaacctgaaaccccggtgatgcaggtaaacagacccaccggcagcgtcagcgtcacgtccttcaggttgttgccgcgtgcgcctgtcagcttcagcactttttccggattcgccggaacgcgtttcttcggcacttcaatcttgcgtttgccgctcatgtactgcccggtcaacgactccggcaccgccataatcgcttccagcggaccttctgcgaccacttcaccgccgtgaacacctgcgcccgggccaatgtcgatcacatggtcagcggcgcgaattgcgtcttcgtcgtgctccaccacaatcacggtattaccgagatcgcgcagatggataagcgtacccaacaggcgctcgttatcacgctggtgcaggccgatagacggctcgtccagcacgtacataacgccaaccaggcccgcaccaatctggctcgccagacggatacgctgtgcttcaccgccagaaagcgtttctgccgagcgggaaagcgtcaggtaattcaggccgacgttaacgaggaatttcagacgatcgccgatctctttaaggattttttctgcaatcttcgcccgctgacctgcgagtttgagattgttgaagaattccatcgcatgaccaatgctcatgtcggagatagcaggcagcggcgtattctcgacatacacgtggcgcgcttcccgacgcagacgcgtcccttcgcagctggcgcacggacgattactgataaacttggctaattcttcgcgtaccgcgctggattccgtctctttatagcggcgctccatattatgcagcacgccttcgaacggatgacgacgaatggaggtatcgccacgatcgttcatgtatttgaattcaatgttttctttgccagaaccgtacaacaccactttatgcacgttcgcgctcaggctgccccacggcgcttcgacgtcgaacttatagtgatctgccagcgatttcagcatctggaaataatagaagttgcggcgatcccagccacggatcgcaccaccagccagcgacagttccggattctggatcactcgatcaggatcgaaatattgctgtacgccaaggccgtcgcaggtcgggcaggcccccgccgggttgttaaacgaaaacagtcgcggctccagttcacgcatactgtagccgcaaattgggcaggcgaagttggcggagaacagcagctcttccgctttcgggtcgtccatatccgccactaccgcggtaccaccggaaagctccagcgcggtttcaaatgactcggcaagacgttgggtaagatcgtcacgcaccttgaagcgatcaaccaccacttcaatggtatgtttcttttgcagttccagttttggcggatcggaaagatcgcagacttcgccatcaatacgagcacggatgtagccctggcttgccaggttctccagcgttttggtgtgttcgcctttgcgctctttaatgattggcgcgagtagcatcagacgcttgccttccggctgcgacagcacgttatccaccatctggctgacggtttgcgccgccagcgggacgtcgtggtccggacagcgcggctcgccaacgcgggcgaataacaaacgcaaatagtcgtggatttcggtgattgtccccaccgtagaacgcgggttatgagacgtcgatttctgctcaattgagatggcaggagaaagcccctcaatatgatcgacgtccggcttttccatcagtgacagaaactgccgcgcgtaggcggaaagggattcaacgtaacggcgctgcccttcggcatataaggtgtcgaaagcgagcgaggatttgccagaacccgaaagcccggtcacgacaatgagcttgtcgcgggggataacgaggttgatgtttttgagattatgggtgcgggcgccccgaacttcgatcttatccattcacctttcccggattaaacgcttttttgcccggtggcatggtgctaccggcgatcacaaacggttaattatgacacaaattgacctgaatgaatatacagtattggaatgcattacccggagtgttgtgtaacaatgtctggccaggtttgtttcccggaaccgaggtcacaacatagtaaaagcgctattggtaatggtacaatcgcgcgtttacacttattcagaacgatttttttcaggagacacgaacatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagaacagactgaatggcaccgcgttgtgctgttcggcaaactggcagaagtggcgagcgaatatctgcgtaaaggttctcaggtttatatcgaaggtcagctgcgtacccgtaaatggaccgatcaatccggtcaggatcgctacaccacagaagtcgtggtgaacgttggcggcaccatgcagatgctgggtggtcgtcagggtggtggcgctccggcaggtggcaatatcggtggtggtcagccgcagggcggttggggtcagcctcagcagccgcagggtggcaatcagttcagcggcggcgcgcagtctcgcccgcagcagtccgctccggcagcgccgtctaacgagccgccgatggactttgatgatgacattccgttctgatttgtcattaaaacaataggttatattgttttaaggtggatgattaaagcatctgccagccataaaaaagaagcctccgttatggaggcttctacgtatcaggtcaaaatcattggccattgtggcggtgtctgattcatctcttctatcatcaccgactcgatgttgtgccagatagcggtgatgtccgccattgtgatgccaagcaaccccattgcgaaccaacaggcggaaacaacgcccagaccgctgctgatcaccgcaagcccgacataatcagaccgacgaaaacggatgttgagtgtgctggccagaaacatcattacggcactaagaagttgccagcgaagaagaaccacgccagtggtgagggtagccatcaaacaattcctctgaaaagagccgatgccctggacagcgcggcgttgttcacgggaggcgtggtacactctggctatcgcggggcttgcagaacacaaaaatgaaacactctgtttgtttcattaattttgtgaactatatcacaattgattgtttgttagccatattaggccgtgacttttattgctgtacagattatgtggtttttcagtggcattaagggcatatcttcccgccgcctctgcattcctgtaggaaattaattttgaatatcaatgaattattttcatccaggtgacgattagaaaggtatcaatttcaaatcaggcaaaagtgctatttataccgtaagatttatctaaagacgtcggtacccagggttttcaccttgcaatggccgggtataaacaggcaggaaattgatagcaatgagtcatcgtgcacgacaccaattactggcgttgccgggcattatctttttagttctctttcccatcattctttcgctatggattgccttcctttgggcaaaatcagaagtgaataatcagctccgaacctttgctcaactggcactggataaatccgagctggtcattcgccaggcagatttagtgagcgatgcagctgaacgctatcaggggcaagtttgcactccagcccatcaaaagcgaatgttgaatattattcgtggctatctttatattaatgaattgatctatgcccgtgataaccattttttatgctcatcgctgatagcgcctgtaaacggctatacgattgcaccggccgattataagcgtgaacctaacgtttctatctattattaccgcgatacgccttttttctctggctataaaatgacctatatgcagcggggaaattatgtggcggttatcaaccctctcttctggagtgaagtgatgtctgatgacccgacattgcaatggggtgtgtatgatacggtgacgaaaacctttttctcgttaagcaaagaggcctcggcagcaacgttttctccgctgattcatttgaaggatttaaccgtacaaagaaatggctatttatatgcgacagtttattcgacaaaacgcccaattgcagccattgttgcgacttcatatcaacgtcttataacccatttttataatcatcttatttttgcgttgcccgccggtattttggggagtcttgttctgctattactctggctacgtattcgacaaaactatttatctcccaaacgtaaattgcaacgcgccctcgaaaaacatcaactttgtctttattaccagccaataatcgatatcaaaacagaaaaatgtatcggcgctgaagcgttgttacgttggcctggtgagcaggggcaaataatgaatccggcagagtttattccgctggcagaaaaggaggggatgatagaacagataactgattatgttattgataatgtcttccgcgatctgggcgattacctggcaacacatgcagatcgctatgtttctattaacctgtcggcctccgattttcatacgtcacggttgatagcgcgaatcaatcagaaaacagagcaatacgcggtgcgtccgcagcaaattaaatttgaagtgactgagcatgcatttcttgatgttgacaaaatgacgccgattattctggctttccgccaggcaggttacgaagtggcaattgatgattttggtattggctactctaacttgcataaccttaaatcattgaatgtcgatattttgaaaatcgacaaatcgtttgttgaaacgctgaccacccacaaaaccagtcatttgattgcggaacacatcatcgagctggcgcacagcctggggttaaaaacgatcgctgaaggcgtcgaaactgaggagcaggttaactggctgcgcaaacgcggcgtgcgctattgccagggatggttctttgcgaaggcgatgccgccgcaggtgtttatgcaatggatggagcaattacccgcgcgggagttaacgcgcgggcaataaaattacaggcggtggcgataatcgctgggagtgcgatcaaactgccgacggaaaacgcgggagaaggtctgctgcgagacataacccaggtccattgcgatatcaaaaatcggacgctcggtggtgcgcaactcaacggcggccagtaacaggcggcgttggcgaatgtaatcgccaagcgtctgatgcgtcaccgtgcggaacattcgttgcaagtaccactttgaatagcctgatttttttgcgactacatcaatgttaagcggctggtcaatatgctcgtcaatccatgcgataagatcctgaataattttctgatgggacataaatctgcctcttttcagtgttcagttcgttaattcatctgttggggagtataattcctcaagttaacttgaggtaaagcgatttatggaaaagaaattaccccgcattaaagcgctgctaacccccggcgaagtggcgaaacgcagcggtgtggcggtatcggcgctgcatttctatgaaagtaaagggttgattaccagtatccgtaacagcggcaatcagcggcgatataaacgtgatgtgttgcgatatgttgcaattatcaaaattgctcagcgtattggcattccgctggcgaccattggtgaagcgtttggcgtgttgcccgaagggcatacgttaagtgcgaaagagtggaaacagctttcgtcccaatggcgagaagagttggatcggcgcattcataccttagtggcgctgcgtgacgaactggacggatgtattggttgtggctgcctttcgcgcagtgattgcccgttgcgtaacccgggcgaccgcttaggagaagaaggtaccggcgcacgcttgctggaagatgaacaaaactaaagcgccacaagggcgctttagtttgttttccggtctttgtctttctctctatcccgctggtacacaggagggtttcccccgacgtcaacacacctcattcgagcacgtggtggaggttccggttggtgttgatgctttaattgtatgtcaccgacgtttcttcgccagtgtaaaagtatactttttaaccgcaatatttttgtcatctcagacgattttttatcgcaatcctgaacggtatacggctcgataacgctgcaatcttgcgcaccgacgataacgtttgcgcatcaattgcctggtttttcatcgtcaagacaataaaagagaaaaaagcagcaaacttcggttgaaaaagccgctatgatcgccggataatcgtttgctttttttaccacccgttttgtatgcgcggagctaaacgtttgcttttttgcgacgcagcaaattgtcgcaaacctggagcaggaagataacgtttcgctggcaggggattgtccgccacgcatcttgacgaaaattaaactctcaggggatgttttcttatgtctacgccatcagcgcgtaccggcggttcactcgacgcctggtttaaaatttcacaacgtggaagcactgtccgtcaggaagtggttgccgggttaacaacgtttctggcgatggtctactcggtcatcgtcgttccaggtatgttgggtaaagcaggcttcccgcctgcggcagttttcgttgcaacctgtctggttgccggactcggttctatcgtgatgggtctgtgggctaatctgccgttggcgattggttgcgccatctccctgacagcgtttaccgcattcagcctggtgctggggcaacatattagcgtacctgtcgcgctgggtgccgtgttcctgatgggtgtgctgtttacggtaatttctgccacgggtatccgtagctggattttgcgcaacttgcctcacggtgtggcgcacggcacggggattggtatcggtctgttcctgctgctcattgccgctaacggtgtcggtctggtgattaaaaacccgcttgatggtctgcccgttgcgctgggtgatttcgcgaccttcccggtgattatgtcactggtaggtctggcggtgatcatcggcctggaaaaactgaaagtccctggtggcattctgctgaccattatcggtatctcaattgtcggtttgatcttcgatcctaacgtccatttctccggcgttttcgccatgccttcattgagcgatgaaaacggcaattcactgattggcagcctggacattatgggcgcgctgaatcctgtagtcctgccaagcgttctggcgctggtgatgacggcagtatttgatgccaccggaactatccgtgccgtcgccggccaggcgaacctgctggataaagatgggcagatcatcgacggtgggaaagcactgaccactgactccatgagcagcgttttctctggcctggtgggtgcggctccggcagcggtatacatcgagtctgcggcgggtacggcggcgggcggtaaaaccggtttgacggctatcaccgttggcgtgctgttcctcctgattctgttcctctctccgctctcttacctcgttccggggtatgcaacggctccggcgctgatgtacgttggcctgctgatgctgagcaacgtggcgaaaatcgactttgctgattttgttgatgcgatggcgggtctggttacggctgtattcatcgtgctgacctgtaacatcgtaacaggcatcatgatcggcttcgcgactctggtgattggtcgtctggtttccggcgaatggcgcaagttgaacatcggtacggtcgttatcgccgtggcgctggtgaccttctatgcgggtggctgggctatctaatctttcatcggattctgaaaacgggtggcaatggctgcccgtttttattttctccgcacattgtgtgagcttttgcgatattctgaaaaaaatgagaattcaggcataacgtctttctcagatcataaaaaacatcgcaaacagggaacgcatggaaatcttcttcaccatactgataatgaccctcgtggtctcgctgtccggggtggtcactcgtgtcatgccctttcagatcccgcttccgcttatgcaaatcgccatcggtgcgctactggcgtggccgacgtttggtttgcatgtggagtttgatcctgaactctttttagtcttgtttatcccgccgttgctgttcgctgatggctggaaaacgccgacccgtgaatttctcgaacatggtcgagagattttcggcctcgcgctggcgctggtggtggtcaccgtggtcggcattggcttccttatttactgggtggtgccgggcattccgctgatccctgcctttgcgctggcggcggtgctttctccgaccgatgctgtggcgctctccgggattgttggcgaagggcgcatcccgaaaaaaatcatgggcattttgcagggcgaagcgttgatgaatgacgcctccggtctggtgtcgttgaagtttgccgtagcagtggcgatggggacgatgatcttcaccgtcggcggtgcgacggtcgaatttatgaaagtagccattggcggtattctcgccggttttgtggtgagctggctgtacggtcgctcgctgcgattcctcagccgctggggcggtgatgaacccgcgacgcagatcgtcctgctgttcctgctgccattcgcttcttatctgattgccgaacatattggcgtttccggcatcctcgctgcggttgccgccgggatgaccatcacccgctccggtgtgatgcgccgtgcgccgctggcaatgcgcctgcgtgcaaacagcacctgggcgatgctggaatttgtctttaacggcatggtgttcctgctgttaggtctgcagctgccgggtattctggagacgtcgctgatggcagcagaaatcgaccctaacgtcgaaatctggatgctgtttaccaatattattctgatatatgcggcgctgatgctggtccgtttcggctggctgtggacgatgaaaaagttcagcaaccgcttcctgaagaagaagccgatggagtttggttcgtggaccacacgagaaatcctgatcgcgtctttcgccggggtgcgtggggcgatcactctggccggtgtgctctctatcccgctgctcttgccggatggtaacgtcttcccggcgcgctatgagctggtgttcctggcggctggcgtcattctcttctcgctgtttgtcggcgtggtgatgttgcctattctgctacaacacattgaagtcgcggatcattcgcaacaattgaaagaggaacgtattgcgcgagcggcaacggcagaagtggcgattgtggcgatccagaaaatggaggagcgtctggcggcggataccgaagagaatatcgataaccagctgcttacggaggtcagttctcgcgtcattggtaacctgcgtcgtcgcgccgatggacgtaacgacgttgaaagttccgtgcaggaagagaaccttgagcgtcgcttccgtctggcggcattgcgttctgaacgtgctgaactttaccacctgcgcgccacacgggagatcagcaacgaaacgctgcaaaaattactgcacgatctcgatttgcttgaagcgttgctaattgaggaaaatcagtaagccgaaagcgacgtaaccaggcccgaggtaatctgaaaaaggtgcaatcttttgcacctttaacaggttagctcgggctaacattcatgattctaaaacaaataaattatctctcttttaaagtcaattcattggctgttcttcgacttaacctcaatctgcatcttgcataatatctgcagtaatcttcatagcgactgcatgaagattatcctcagtttgtgacatgccagtatgagtggcacaatcttcttcaaagaatttctgtagtgttaccaggatatcactattaatggagatattttcctcaccacggagaatggtaatacccattccctggacgctagcctcatcgaaattaacacgatagagacggatattaaacatccaggcttttgttaaaacagaacagttgaaatggcaattgcttaaattggcattattaaaattaacattagccatattagagtcggtacatataaccatttcgaggaacgtatttgttaaccgcgtaaaaaagagtttgctatcaattaagtttatattctggagggttgctttattcaggttgacacgagacagatcagcatgttcaaagttaattaaatcaagtttagagaagctaaggtcggctctaaataaattaatatatggcgctattactttataaagatttacctcagccatgtatgccatataaaaatttgaataatcaaggaaggtatttttaatattggctctattcattgttgcattgtagaattgaacatgcatagcggaacatgaatttagagttccgtcagtcatttttatctgagcgaaatttgagtcatcgagaatacaattatcaaaaagtattttttccattatggcgaaattaaaattcgttttatacatattacagtcctgaaaaatagcgttttgtagtctgcaacctgcaaaattcgaattggataaatcttcatctttaatcacgatacctttcaggctaaggtgtgaaaaatcgtaaccaccatttactgtctgtgggatttcgatagtattattatggacggtgacattatttataaaatataccaccttaattgacacttccttatctttattaaggtaaactcttctcgtaattctatcgtcacatttattatttgcatgtgaagctatatctataaaatatttatgtattttcctgtccgtttctttcgtgatttttcctgatggtaaactatcataaattcttttcattttctgaatcaagcctatcactttttcatgatcatccattttgaaaagagagagggctttattgtcaattaacgtgtttttatgatgtttgctgtaattatctgattttgttttctttgtatgtgatggacttgtgacagagtggttatcgttaatcaggcaaagagggaaaaacatattatttaaaccattatagcgcataaaatatccttataattaacaagaaagaaaaggcatattctctgcattatcattttctacgactgtcaaaaatcgctcattttttaatgagtttatttgtttaatattatgggaaaaggtgatgcatttgggagaggaagagtattccccggtcagacgaccggggaaggggagagattaatgcgcgcggccttgctcaacgccaaagccggtctgggagcggataaactgcgcgcggaacagttcacgctcacgcgcgccttccgctgagttatcggttgccgagaagaaccagatgccgaggaatgccacggtgatagagaacagcgccgggtattcatacgggaagatggctttttcgtgaccaaggatctgtacccaaatcgtcgggccgaggatcatcagtactactgcggtaatcagccccagccagccacccatcatcgcgccacgcgtggtcagtttcgaccagtacatagaaagcagaatgatcgggaagttacagctcgccgcgatggcaaacgccagccccaccataaaggcgatgttctgattctcaaacagcacgccgaggataatcgcaatcacgccgaggatcagtacggtgatttttgatacccgcagctcttcacgttcggtcgcgccttttttgaagacgttagcgtacaagtcatgcgaaaccgcggatgcgcccgccagcgtcagacccgcaaccaccgcgaggatagtggcgaaagcaaccgctgaaataaaaccgaggaacaggttgccgcccactgcattcgccaggtgaacggccgccatgttgttaccaccaatcagatggcccgccgcgtctttatattccggattcgcaccaaccagcatgatcgcgccgaagccgataataaaggtcagaatatagaagtagcccataaacccggtggcgtagaacacgctcttacgtgcttcgcgggcatcgctgactgtaaagaagcgcatcagaatgtgcggcaagcccgccgtaccaaacatcagtcccagacccagagagagcgcggagatcggatctttcaccagcccgcccggcttcatgatgtcgacacctttcgggtgtaccgccatcgcttcactgaacagattgttgaagctaaagccgacgtgtttcatcaccataaaggccataaagctggcaccgaacagcaacagcacggctttgataatttgcacccaggtggtcgccagcatgccgccgaacaggacgtacatcatcatcagcacgccgaccagcaccaccgcaatgtgatagttaaggccaaacagcagctcgatcagtttacctgcgcccaccatctgggcgataaggtaaagcgccaccaccaccagagaaccacaggccgaaagaatacgaatcggcccttgtttcagacggtaagaggccacatcggcaaaggtgtagcgccccaggttacgcagacgttcggcaatcaggaacaaaatgatcggccagcccaccaggaagcccagcgagtaaattaagccgtcatagccggaggtaaacaccagcgcggagatccccaagaatgaggcggcggacatatagtccccggcaatcgccagcccgttctggaagccagtgatattgccgcctgcggtgtagtagtcgctacgagaacgtacgcgttttgatgcccagtaggtaatgccgagcgtaaacacgacgaaaatcaggaacataataatcgcctgccagttcgttggctggcgctctacggccccgctaatagcatccgcggcgttagctgcgaaagggagtgtggcggcaagcgccgtcagaactcttttcatgatgcttgtacctcatgcaggacttcattattaagacggtcgaattcgccgttcgcccgccagatgtagataccggtgagaacaaaggagatcacaatcactccaacaccaattggaataccgcgtgtgacgctggtgttcggattcagcggcgtgcccagccagccgggcgcgaaggcgatcagtaaaataaagccgatataaactgccagcataataatcgacaggatggtggcaaaccgttgccgtttttcgactaactccctgaaatgcgcattgtcttctatccgctgataaatagtgccattcatcacagattctccagaggtaatgtagggattgttttaattcccgctcccttatgggagaaggttaacgctcgggtaacccttgccgaatgtaggccggataaggcgtttacgccgcatccggcaatcaatgcctgatgcgacgctgtcgcgtcttatcaggcctacaaaccgttaccgactcgcatcgggcaattgtgggttacgatggcatcgcgatagcctgcttctcttcaagcagcttctcgactacgccaggatcggcaagcgtcgaggtatcgcccaggttgctggtatcgcccgccgcaattttgcgcagaatacggcgcataattttgccggagcgggttttaggcagggagtcggtccagtgcagcacgtctggcgtcgccagcgggccaatctctttacgcacccagttgcggacttctgcgtacagttctggtgacggttcctccccgtgattaagcgtgacgtaggcgtagatcgcctgacctttaatattgtgcggaatacctactacggcggcttcggcaatcttcggatgcgccaccagcgccgactcaatctctgccgtccccagacggtgaccggagacgttcagcacgtcgtccacacgcccggttatccagtaatagccatcttcatcgcgacgcgcgccgtcgccgctgaaatacatatttttgaaggtggagaagtaggtctgttcaaaacgttcgtgatcgccaaacagcgtacgcgcctgacccggccaggagtcggtgattaccaggctaccttcggtggccccctccagcgggttaccttcgttatcgaccagcgccggttgcacgccgaagaacggacgtgttgccgaaccggctttcagctcggtagcgccaggcagcggggtgatcatgaaaccgccggtttcggtctgccaccaggtatcgaccaccggacatttctcgttgccgatttttttccagtaccactcccacgcttccgggttaattggctcgcccacggaaccgagaatgcgcagcgacgaacggtcggtgccttcgatcgctttatcgccttccgccatcagcgcgcggatcgccgtgggtgcggtatagagaatattgacctgatgcttgtccaccacctgcgccatacgggcaggcgtcggccagttgggtacgccttcaaacatcagcgtggtcgcaccgcaggccagcgggccgtacagcaagtaactgtgtccggtcacccagcccacatcggcggtgcaccagtagatatcacccggatgataatcaaagacatatttaaaggtcagcgccgcgtacaccagataaccgccggtagtatgcagcacaccttttggcttaccggtagaaccggaggtgtagagaataaacagcggatcttcggcgttcatctcttccgcctggtgctgatcgctcgcttgctcaaccaggtcgtgccaccacaggtcgcgcccttcctgccagtcaattttcccgccagtacgcttcagtaccaccacatgctctacgctggtgacgttcgggtttttcagcgcgtcatcaacgtttttcttcagcggaatactgcgcccggcacgcacaccttcgtcggaagtgatcaccagtcgtgagttggaatcaataatgcgcccggcaacggcttccggcgagaagccgccgaaaatcaccgaatgcaccgcgccaatgcgggcgcaggccagcatcgcaaccgcggcttccggcaccatcggcatataaatcgccaccacatcaccttttttaatgcccagctcgagcagggtattggcgaagcggcagacgtcgcggtgcagctctttatagctgatatgtttgctctggctggcgtcgtcgccttcccagatgatggcggtacgatcgccgttttcttgcagatggcggtcaaggcagtttgccgccagattcagcgtgccgtcctcgtaccatttaatggacacattaccgggggcaaaggaggtgtttttcaccttctggtaaggtttgatccagtcaagaatttttccctgttcgccccagaaggtatcaggtacgttaatagattgttgatacatcgcctcgtactgctgagggtttatcaggcaacggtctgcgatgttggcaggaatggtgtgtttgtgaatttggctcatgcttttgttctccttgtaggatgttaataatatgtggcataagcgttaaatgtaggggtattggcagttttgtttagtatttgggcgacagatcacgcaaaagtagaattgtgcaaataaacggcagggtaatttttgaaggtcagcaacaaaagttgattaattctttgaggaacatgcagttatgcatgctgttgaaaaagaggaagatactgactaactctaaagtggtattttacatgcacttacaattgattaaagacaacattcacagtgtggttatttgttacacataggggcgagcaatgtcatgacagtgtaggtgcggttactgtcgtgaaaaacaataaaaaccgccattgcaacaatggcgcaattcggatgaagcccctatgacaaggataaaaataaacgcacgccgtatcttcagcttattgattccttttttctttttcacttctgttcacgctgaacaaacggctgctcccgcaaaacctgtaactgtggaagcgaagaatgaaacctttgccccgcagcatcccgatcaatatctctcctggaaagccacctcggaacagtcagagcgtgttgacgccctggcggaagatccacggctggtgatcctgtgggcggggtatcccttctcgcgcgattacaacaagccgcgtggacatgcttttgctgtgaccgatgtgcgtgaaaccctgcgtaccggtgcgccgaaaaacgctgaagatggtccgctaccgatggcatgctggagttgtaaaagcccggatgtggcgcgtctgatccagaaagacggcgaagatggctacttccacggtaaatgggcgcgcggcggtccggaaatcgtcaacaacttaggttgtgccgattgccataacaccgcctctccagagttcgccaaaggcaaaccggagttaaccctttcccgtccgtatgcggctcgcgcgatggaagccattggtaaaccttttgagaaagccggacgtttcgaccagcaatcgatggtttgcggtcagtgccatgtggagtattacttcgacggcaaaaacaaagcggttaaattcccgtgggatgacggcatgaaagtcgaaaatatggagcagtattacgacaaaattgccttctctgactggactaactccctgtcgaaaacgccaatgctgaaagcgcagcacccggaatatgaaacctggacagcgggcattcacggtaaaaacaacgtgacctgtatcgactgccatatgccaaaagtgcagaacgccgaaggcaaactctacaccgaccataaaattggtaatccgtttgataacttcgcccagacttgtgcgaactgccatacccaggacaaagctgccttgcaaaaagtggtcgcggaacgtaagcagtcgattaacgacctgaaaatcaaggttgaagatcaactggttcacgctcacttcgaagcgaaagcagcgctggatgcaggcgcgacggaagctgaaatgaagccaattcaggacgatatccgtcatgcccagtggcgctgggatctggcgatcgcttcccacggcattcatatgcacgcaccggaagaaggtttacggatgctcggtacggcgatggataaagcggcggatgcacgcaccaaactggcgcgcctgctggcgaccaaaggcatcacccatgaaatccagatcccggatatctcaaccaaagagaaagcccagcaggccattggcctgaacatggaacaaatcaaggccgagaagcaggacttcatcaaaacggtgatcccgcagtgggaagaacaggcacgtaaaaacggtctgttaagccaataaccccgttccgcctcgcaaggggcggaaaacacaatggagtgaatatgagcgtattacgttcgttattaactgccggggtgctggcgtcgggcctgttgtggagcctgaacggaattaccgctacccctgcggcgcaggcatctgatgatcgctacgaagttacccagcagcgtaacccggatgccgcctgtctggactgtcataaaccagataccgaaggtatgcatggaaaacatgcttccgttatcaacccgaataacaaactgccggtcacctgcaccaactgtcacggccagccatcaccgcaacaccgcgaaggggtgaaagatgtgatgcgctttaacgagccgatgtacaaggttggagagcagaacagcgtctgtatgtcctgtcatctgccggaacagttgcaaaaagcgttctggccgcacgatgtccacgtaaccaaagtggcgtgcgccagctgccattccctgcatccacagcaagatacgatgcagacgttaagtgacaaaggacggattaagatttgcgtcgattgccacagcgatcagcgcaccaatccgaactttaacccggcgtctgttccgttgcttaaggagcagccatgacctggtctcgtcgccagtttctcaccggcgtcggcgtgctggcagccgtcagcggcaccgcagggcgcgtggtggcgaaaacgttgaatatcaatggggtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgacgtctgcccgaccggtgcgtcttttcgcgatgctgccagtgggattgtcgatgttaatccggatctctgcgtcggttgtcagtactgcatcgccgcctgtccgtaccgcgtgcgctttatccatccggtcacgaagacggcggacaaatgcgatttctgccgtaagaccaatttgcaggccggtaagttgcccgcgtgcgttgaagcttgcccgaccaaggcgctgacgtttggcaatctggacgatcccaacagtgagatttcgcaactgctgcgccagaagcccacttaccgctacaagctggcgctgggaaccaaaccgaagctgtaccgcgtaccgtttaaatacggggaggtgagccaatgacgcagacttccgcatttcattttgaatcgctggtgtgggactggccgattgccatctacctgtttttgattggtatttctgctggtctggtgacgctggccgtgctgttacgtcgcttctacccgcaggcgggcggtgcagacagtacgttgctgcgcaccacgctgattgtcgggccgggcgcggtgatcctcggtctgttgatcctcgtcttccacctgacaagaccgtggaccttctggaagctgatgttccactacagttttacctcggtgatgtcgatgggggtgatgctgtttcagctctacatggtggtgctggtgctgtggctggcgaaaatctttgaacatgatttgcttgccctgcaacaacgctggttgccgaagctggggatcgtgcaaaaggttctgagcctgctgacgcccgttcatcgcggactggaaacattgatgctggtgctggcggtgttgttgggggcttataccggctttctgctgtcggcgctgaaatcgtatccgttcctcaataacccgatcctgccggtgctgttcctcttctccggcatctcgtccggtgcggcggtggcgctgatcgccatggcgatacgccaacgcagtaacccgcattccacggaagcgcagtttgtacaccgtatggaaatccctgtggtatggggtgaaatcttcctgctggtggcgttttttgtcggtctggcgctgggcgatgacggtaaagttcgtgcgctggtggcggcattaggtggcggtttctggacgtggtggttctggcttggtgtcgccgggctggggctgattgtgccaatgctgctcaaaccgtgggtcaatcgcagttccggcattcctgccgtgctggcggcgtgtggggccagtctggtcggcgtgttgatgctgcgctttttcattctctacgccggacagttgacggtggcgtaagccagaaaagaggtggtttctggacgtattccttcctgaagtcggttttctggcgttgttgttaagtctcggggtcaacgtgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcgcaacatagctatagcctgctgtcgtgggaactcaagctggcagcggtgtggggcggccatgaaggttcgctgctgctttgggtgctgctgctttccgcctggagcgcgctgtttgcctggcattatcggcagcaaaccgatccgctatttccgctgacgttagccgttttatctctcatgctcgccgcactgctactgtttgtggtgctgtggtccgatcccttcgtgcggatatttccaccagcaatcgaaggccgcgatctcaatccgatgctgcaacatcccggtcttatctttcatccaccgctgctttaccttggctatggcggtttgatggtagcggcgagcgtggcgctggcgagtctactgcgcggcgagtttgatggtgcctgcgcccgaatttgctggcgctgggcgttacctggctggagtgcattaacggcggggatcatcctcggttcctggtgggcctactgcgaactcggctggggcggctggtggttctgggatccggtggaaaacgcctctttattaccctggctttctgccactgcgctgctgcacagtttgtccctgacacgccagcgggggattttttgccactggtcgctgttgctggcgatagttactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcatttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttggtctgttgatgctggtggtgattgtgctggcgacgtttgtctctggcaaacgcgtgcagcttccggcgctggtagctcatgcgggcgtgctgttatttgccgctggggtcgtggtctccagcgtcagccgtcaggagatcagcctgaatttacagccgggtcagcaggtgacgctggcaggatacaccttccgttttgagtgcctcgatctacaagccaaaggcaattacaccagcgaaaaagcgatagtggcactgtttgaccatcagcaacgcattggtgaactgacgccggagcggcgtttttatgaagcacgccgtcaacaaatgatggaaccgtcaattcgctggaacggcatccatgactggtatgcggtcatgggggagaaaactgggccggatcgttacgcttttcgtttgtatgtacaaagcggtgtgcgctggatctgggggggaggattgttgatgattgcgggcgcattgttaagcggatggcgggggaagaagcgcgatgaataaagggcttctcacgctactgctgttatttacctgttttgcgcacgctcaggtcgtagacacctggcaattcgccaatccgcaacaacagcaacaggcgttaaatattgccagccagttacgttgtccgcagtgccagaatcaaaacttactggaatccaacgcgccggtggctgtcagtatgcgccatcaggtttacagcatggtggcggaggggaagaacgaagtcgaaatcattggctggatgaccgaacgctacggagattttgttcgctataacccaccgttaacgggtcagacgctggtgttatgggcgctgccagtggtgttgttactgctgatggcactgatcctctggcgagtgagggcgaagcgatgaaacagcccaaaataccggtgaaaatgctgacaacactcacgatattgatggtatttctctgtgtcggcagttatctgttaagcccaaaatggcaggcggtacgtgcggagtatcagcgtcagcgcgatccgctacatcagtttgccagccagcaaaccccggaagcgcagcttcaggcattgcaggataaaatccgcgctaatccacaaaacagcgaacagtgggcgttactgggcgagtactatctgtggcaaaacgattacagcaattcgttgctggcgtaccgtcaggcgttgcaactacgtggtgagaacgctgaactgtatgcggcgctggcgacggtgctttattaccaggccagccagcatatgaccgcccagactcgcgcaatgatcgacaaagccctcgcgctggacagtaatgaaatcaccgccctgatgctgctggcttccgatgcgtttatgcaggcgaactacgcgcaagccatcgaactatggcaaaaagtgatggatctcaactcaccgcgagttaaccgaacacagctggttgagtcgattaatatggcgaaattgttgcagcggagattggattaatcatctggtgatgaagattatgtcattgagctgcataaaaaataatcgaatgaacatatgccaaaaataatcactaatcagtattattgcagattaaacaaataaaaatctttccataacaaatggttattcattaatcctgccataaactcgcgttattatgcattaatgcagcgaaaagctctgttgttaaagggttgcgcaacataccgcgcaaatgatactgatcataagcgttaaaaaaatctacaaaccaacgcaacacaattcatgccctggcagtatgtcacgttctcgcgtttctgaacggggaacggcgctccattgaggaagtcattcatatgaaaaatataaaattcagcctggcctggcagattctgtttgctatggtgctgggcattctcctgggaagctacctgcactaccatagcgacagccgcgactggctggtcgtcaatttgctctctccggcgggtgatatcttcatccatctgattaaaatgattgttgtgccgattgtgatctccacgctggtggtgggtatcgcgggtgttggtgatgccaaacagctcgggcgtattggcgcgaaaaccattatctacttcgaggtgatcaccaccgtcgccatcattttggggatcactctggcgaacgtcttccagcccggtgccggggtggatatgtcgcagttggcgaccgtcgatatctcgaaatatcagagcactacggaagcggtacaaagcagttcccacggcattatgggcacgattttgtcgctggtgccgacgaacattgtggcgtcgatggcgaaaggcgaaatgctgccgatcatctttttctcggtgctgtttggtctggggctttcttccctgcccgcgacgcatcgtgaaccgctggtgaccgtgttccgctccatctctgaaaccatgtttaaagtgactcacatggtgatgcgttatgcaccggtgggtgtgtttgcgctgattgcggtgacggtggctaactttggtttctcgtctctgtggccactggcgaaactggtgctgctggtgcatttcgccattctgttcttcgcgctggtagtgctgggaattgtggcgcgcctgtgcgggttaagcgtctggatcctgattcgtattctgaaagatgagctgattctggcgtactccactgccagctctgaaagcgtgctgccgcgaattattgagaagatggaagcctacggagcaccggtgtcgatcaccagtttcgtggtgccgaccggttactcttttaaccttgatggttcgacgctgtatcaaagtattgccgctatcttcatcgcgcagttgtatggcattgacctgtccatctggcaggaaatcattctggtgctgacgctgatggtgacctcgaaagggattgctggcgtgcctggcgtgtcgtttgtggtgttgctggcaacgctgggtagcgtaggtattccgctggaaggtctggcgtttattgctggtgttgaccgtatcctcgacatggcgcgtactgcgctgaacgtggtgggtaatgcgctggcggtgctggtgattgccaagtgggaacacaaatttgaccgtaagaaagcgctggcttatgagcgtgaagtgctgggcaaatttgataaaactgcggatcaataattgaagattgccggggatatccacccggcaatgtgtgaatgcctgatgcgacgcttgccgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttacgccgcatccgacatcaacgcctgatgcgacgcttgccgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttaccgcatccgacatcaatgcctgatgcgacgcttgccgcgtcttatcaggcctatcttaaccgttggttaatttttcaaactcttcacacccggtatcaaacccttccatacagctcaggttcaaccagtgcagcgccttttgcttgttcttctcgataaaaccttcttcaccgtttaagaacatcattcccgcccagtactcggaataaccggttcgggaaattgcagagctgcgtttgaaataccaggttgccttgtcatcgtcggccttaatgcccacgccgttggcgtaaatcaaaccaagcagcatttgggcatcgacggcagagtcgttctccagatcttccgaggcgttttctaacagcgaaattgcctttggataatccggtttacccgcttgagtatttaccagaatatgcgccagcgttacttcaccttctttactgcccgcttgcgccgctttctctgcaagaacttttgcttgtggatagtccagactgaccggattggtgattttgatctgcgccagcagcgcgcaggcatcagcatcaccgctgtcggcggctttctgtgcccaatattcggctttgctcaaatcgccggagctaaaccagctgtcggcaagaaaatattgtgcgcgtcggtccccggcctctgctgcctttaaatactggctgccaggctcggagtcgttggcgtgggcaaagaatgtcaaaaacaacatcaatgcgataatttttttcattttgataatacgattgggtagggagtaaccagtataaagagttcgaatggataaaaaaacagcctccgaaaggaggctgtagaaaggacggtattacgccagtgccgcttcgcgcaggcgagttttcaacttgttgtactcgtcaatcacgtactgctcggcggcgcgctgatcggcgatcggctcgacgcgaacggcgcagtatttgtactccggcgttttcgtaatcgggcttaagttttcggtaaccagctcgttacaggcaccaatccaccactggtaggtcatgtaaatcgcccctttgttcggacgatcgctgacctgcgcacgggtgataattttgcctttacgcgagtgcacccaaaccaatgcctcatcttcaatacccagacgtttggcgtcttcggtattgatttgtgcgtagccaggttcatcagccagcgccgccagtgccgcacagttaccggtcatcgaacggcaagagtagtgaccaacttcacgcaccgttgacagtaccatcgggtactcgtcggtgagtttgtcgattggcgctacccagtcgcaggtgaagaactgcgccagaccgttcggggtatcaaacttctctttaaacagataagaagtcccctgatcggcatctgaagtatcgcggcaaggccactgaatgaagcccagttcgcccattttctcgtaagtcgcaccgtagaaatccgggcacagatgacgcaactcatcccagatctcctgggtgttgttgtagtgcatcggataacccatacgggtggcgatttcactgatgatttgccagtccgttttcagatcccatttcggttcaaccgccttgaagaaacgctggaagccacggtcagccgcagtaaacacgccttcatgctcgccccacgacgttgacggtaaaataacatccgccgccgacgcggttttggtcataaagatgtcctgaacgataaccagttccagatcttcaaaggctttacgtactgccgacagctccgcgtcagtttgtagcggatcttcgcccataatgtacgcggcacgcacttcgccatgcgctgcgcggtgcggcagctcgctgatgcgatagccggtatgcgctggcaggctttccacgccccaggctttggcgaatttctcgcggttagccggatctttcacgtactggtatcccggatacgtatccggcagcgcgcccatatcgcaggcaccctgaacgttgttctgaccacgaaccgggttaacacccgcatgcggcttaccgaggttaccggtcagcatcgcgaggctggtcagagaacgcacggtttccacgccctggtagaactgggttacacccatgccccacaggatggcggcgcttttcgcctgggcatacatccgtgccgcctgacgaatctcactggcgctgacgccggtgatatcttcaaccgactccggcgtgtagccttcaacgattttacgatactcttcaaagccttctgtacgtgaagcgacgaacgctttgtcgtacagattttcttcaataatgacatggcccatcgcattcaacagcgcgatgttcgagccgtttttcagtgcaatgtgcatgtcagcaatgcgcgcggtttcaattttgcgcggatcgcagacgataattttcgccccgttacgtttagcgttaattacgtgattcgccacgattgggtgggaatccgccgggttgtacccgaaaacgaacactaaatcggtattatcaatttcgttaatagcattgctcattgcgccattaccgaccgattggtgcagacctgcaaccgatgggccgtgtcagacacgagcgcagcagtcaacgttattggtaccaataacggcgcgcgcaaatttttgcattacatagttggtttcgttacccgtaccacgcgaggagccggtcgtctggatggcatccggaccgtacttctctttgatggcgctcaggcgctcggcaacgtaattcagtgcctcatcccaggaaacaggttcgagtttgccgccacgctggcgacggatcatgggggttttcaggcgcggggtcaggatctgggtatcgttaatgaagtcccagccataataacccttcagacacagggtaccctggttggttttcccctgcgctgcctccgcccggacgattttgccgttatcgacgaccaggttgattttgcaacctgatgcgcaataggggcaaaccgtgacgacttttttcatcggtctcgctccagttaatcaaatcacgcatacgcgctctcgactacagtatgcatcttttatgccacattttatgtggggtcattccctgatattacgggcactatttattcaaaactctgacgaaaaacaggctgtcgtcagttttgacgtgacgaaacgaaataccgcgtgacagccatcacgcggcagacattttattttttctcgacgacgggacctgcctgatacccgccgcccagcgatttcatcaactgaatgctttggatcacccggcggctgtccagcatcagtaatgacatctcttcggcaagcactggcaaccgggcttcggtggcctgtaagcggctggttaagccgcgctgataggcggcctcggcagcgcgctgggtaaagcgcgtggcttccacgcgttcagcctgcatttctcgctcgtcgttgagcgtttgcagacgcgtgccgttgacggcaacgtcacgcaccgcgttcagtactgactggttgtaacgttcaatcatcatgttgctggcggcgcgcgtgccttcgagattggcattcaaccgtccaccgtcaaacagcggcaatttcagacccgggatgaagttgaactggcgactggtttttttgaataaggtatgcagatggatggagtccagaccgaaaaacgctttgatatcaaagctcggatagaacaacgcccgcgcggaatccacctgatctaatgacgcctgaacataccagcgcatggcttgcagatccgggcgtctggcgagcaactcataagagagtgtcgccggaatgccggtctggacttgcggtaatgccaccggtctgatctccggcatatcgctggctcccgcgccaatcaatgcacgcagagattctcgcgtttcggtgatttgccctttgacggcaacaatttgtttatcgaccgccagaatctgtgcccgcgcgccgtggaaaggcacttgcgcttccagaccgtgcgccactttactctggtgcgctttcaccgcgtaatcaatcacatcgtgagtttgttctaacagatcgagcatctgatagctggcctgcatactgtaataaagctgcgctacgcccgtggccagcgatagctctactgctgcggtttctgccagcgcggcattatgcgcgccaatggcggcggcaaccgctgagcgatgcacaccccacaaatcaagatccagtccggcaaacaaacctactgtggcttccgtatagtacggcccgtccatacccagtgctggcgcatccattgaataagggcttaaaaagccgttcgccgagacacgttggcggttgagcatccctaacgctgcgacctgtaattgtgaaccggcatctaacaaatcggcctgggactgcgctttttcttcccgcagtttcgcttcggcgagggtgtgtgaaccacttagcgtccgttggatcagcgcatccagctgcgggtcattgagttgtttccaccactgcgcctgcggccagccggagctggcaagatgaatatcgtcggccagtttgatttgttccggtttgagctgttgatgaggtgcagaatccttacgtaccagggcacagccggaaatcagcgtcgtgctgccgagaatgctgcacaacagcagacgtgaaagttgacgattgatcattgcgtggctccttgtgcctgttccgtggcgggcgttaatgccggggctgtccagtctggcaagcgggcgaaaagctggcagacgtgttgctcctgttttaataaggtgggcaggatggcctgagaggcgggtgtctcttcaagcgttatttgaggagaacggctgagtgcggttgccagaccggcagcgtatttctccagggcgtcggcaaactgacctgctctgtccggctgtagtgcgttatccagcgcctgcgccgagttccaggtggcatcccaggcgtgaagaagatcgcggccctgacgaataaccgtttgcgaacgttcaatcagtaatgcgcgttcttcgctgtccagttgacgctccagcgccacgcgttggcacatctcttcacaggcattaaacgccgcatgcagaccgatacgaatttgcagataagtgcgcagagccgtgacttcctgctggcgtgggatccgcattactttacttaacatacccagcgtgccagccagtttttgcggcagtgtgcgcgcttcactttcaggccagacaaaggtgtaaatcaccgcggacaccacggtaccaatgatgatacccagggcgcgatcgcgaatttccaccaggtcgtacactgggccaaaaacgttttcgagcgtggcgagcgcgaaggtgaccaccatctgtgtgccgatataagaagagcgttcagagctggtggcaatccatgcgcccaacaggaaaatcggtgccagcacaaacagcaattcgacaatattgtccagccagggcatgaccagtagcgtgaataacagcgccagaatcgcgccgcaaaaggccccgccaaaacgcagcaccatcttctggtacgacgaaccgacatttgggttagcgacgatcacgcatgtcagcatacaggtgtgaatgccttcccagtccacgccgctgtaaaaggtgtaacagatcaaacaggcgagcagcgtttttaccgcgtagcgcatatagtctggattggtaaaagcatcggcggccattgatggcggtttggctgcgggcgttggcggcgtattcgggtccatctgacccagttgtaacaacgtctggcagatattctccaggttacattcccgtgccgccatcgcttcactttcactgatccgccagtcgctttgccagcactgaccttcagcaacggcatgctgcagcttgttgatttctgaagctaatttttgtcggaattcaataattgcctgagaatcagcaaaagaggtgggatcgtagcgattcagcgtcgagtaaatgtaggttaccgttgccacgcagctttgccaccatgcgttttgagttcgccagttggcatcgtccgcgaggcaaaagacattgagtttttgtagcgccagcgcctctctttcaatccgcgtttcgggtagcggtgcgaggctgtctgtcaggtgactaatggcatcatcaagccgatcattaagcgcctgatgcatttgcgaaatggcacgactgggaaaccacagcacgccgattaacgtcatcagcaaggttggatagaggccaacaacgatacaccacagcgttaagcgcacgaccacttccggatagtcgagcatggcggggaaggtttgcccgtaaatagcgacaatggcgacggcgaaaaagaccagccccaagcgatgggtgcgcatcaaaaacatgcagcccatcaggatcggtccggcgatgatcaatcggatcaacggttcgccgtatgaccatttgtagatcaaaaacaggctgccgatctccagcaccgtggcaaccacaaacaagatcgcgacaaatttggtgtaaaacgcgttcgactgaataccgtaaaacagcactgccagcgataacgccacaaaagggatctcaaaggtcatcgagatcagaatcaccagcaggcagcctacccagagttgcacggtctgcggcacgcgacctggtcgccgctcgcttaactcttcatgaaagaacgccagcagcctgaccaccggtaatggcagggagttgagcgcgctcattattgcggctcaagattagcgactgccgaagcgccgatgcggaacatttccgggtcaggtttatcgaccatgattttgaccggaaaacgctgggcaacgcggacccagttaatagaacgagacactttcggcaggccgcccagcaccaggccgccgtcatccggtagcacgccgtagccaatcgaatccactttaccctcgaaggttttgccgctgtcactcatcaggcgaatcgttgcgggtgtacctgagcgaatatttttcagatcggtttcgcggaagttggcgatcacataccagtgacgagtgtcgattagggtaaaaatagggcgcatggcagaagcaaattgcccgacggaggttttgagggaaatgacccggccatcaaacggcgcgcgaacggtcgccatttccagatgcagtttggtcagggcaatatccgcttcgaccgccgcacgctgggcaactaatgcatccacgccgctgacggcgctggcggctgactgcgcctgtaacaatacggcattaagatccgcttctgcggcgcgctgcgccgttcttgcacggtcaacatcttccgctgagacaaaaccttctttcagtaatggctcggtgcggcgtaatgtatctgtggcctgtttcgcggcggcacgggctttttctaccgtggcattaaccgagtcggcaccaaactgttgcgcgtcaacgctacgctgggtgagcataatttgcttatccagcgccgcgagggaggcttcagctttcgccagattggcttcgtacgggcgcgggtcgatgcggaacagcaaatcgccctgtttgactgcctggttgtcggtgaccgccagttctacaatgcggccgctgacttccggtaccacatcaatggtatctgctgacgcgtaagcgtcattagttgatggcgcactgtctacgcgccagataacgaaaacaagggcaaccagcgccaacgcaaccactaacagagcagggaatttactgcgaggagcttttttcggcgtactttccatgagcgcgtctcaaatagattagaaaaatgccagccagaacagcatggcgtagagagcaaaaagggcggtataaataattccgacaaatgccagattgatatttgcccgctgaataactcgcctcgtgatgagcgtcaaaataaggctggcaatggcgcagaaaaaccagctgggataataagcgccgatcaccgggattgccggagataatgagcatcccgaaaccatgaagacgggaattatccaggctgtttttttgagttgcatcgccatgcgagagagaactgttggcatattaaatacatcctgtctgctgcgaacaatatctgtagtgaatatcaatatccattgaaggcgtcagtatggctattttcttgatgaataaaaatagctttattcagccaccgcattcataacttatatattttatttattaattggctgtatatatttttaaaataaatacttttgggggcttcagcgcccccaaaagcgagtgacattaatttggggttacgatattcacccacaaatcgaaattatccagacaggcgataatttcttccagtttcgcgccattgccaataattttggctttcttcgcttttaccagatccgccattttggcttgtccggtcagcacggcgtgcagatcttcacggctgatgtagaaagaggcgtcggcttgcggttgcagcgttttccggtagttaagcacgctatcgttcagcgtcaggttgaggttatcgccgttgctcatattgaagttcaggctgatatttttacccgcagctttcgcgctatcgaggcgaacggccataaagtcgaacagcatttcgaccgacatcccgcgaatggtgtccggggaaccggtggtgccgtggctgaacttatgcaccccttcgcgcagctctttcgcgccggtcaggtagaaaccgcgccatgtggcggactcggcctgatagcccagctgttcaaagttattcgcttgcagattcttcgcgacctggtcacccgggttggcggcaatcacctgtttcagcagttctgccgaccagcggtaatcaccttgcttgttcgcttcttgcgccaggttgatgacacgggcagaaccgcccagcgcctgcacgtaacgtttacccatctccacctgaccatacggatgcaggttagccgggttaccgtcgtaatagccaagatagaagttatacaccgcgcgggcgttgtggctgacagaaccgtaatagccgcggctggcccagttattggcaagtgcaggcggcagcttaatcatgtcgccgatttcattcatggtgtagccctggttcgccaggtgcagggtctggtcgtgaatgtacttgatggtatcgcggtatttaccaatataatcattgatatgcttattgccccagaccggccaggtgtgcggcataaacagcacttccgcgtcgttaccccacatatccagcgtttcgttcagatactcggtccacttgctggtgtcgcgggttttcgcgccgcgcagagtgtagaagttgtgcagggtatgcgtggcgttctcggcggtacacagggctttcagggccggaatatagaagtgcatttcggctggcgcttcgctacctggggtcatcaggaagtcaaactccaggccgtcgataatcatcttctcgccagttctgacgatagttttcgtcggtgcaataatgctcgggtcgcccgttgccagcgtcacgccaaggccattacccacattgccttgcgcgttgtgcggcagtaacagaccgtaagagtagagcgcacggcggctcatgatgttacccgccagcacgttttcgctgatggcttcgtccataaagcctgcaggggcaatcacctgaactttgccggatttaacatcggcttcagagataatgcctttcacgccaccatagtggtcggtgtggctgtgagtgtagataacggcaacaatcggtttttgcggacgatgctggaagtaaaggtcaagtgcggcttttgcggcaggcggcgtcaccagcgggtcgataacaataatgcctttctcgccctcaacgaacgtaatgttagagatatcctggccgcgcacctgatacattttatcggtgactttgaacaggccagaaataccgttgatttgcgactgacgccacaggctggggtttacggtttccggcgctgcggcattaatatcaaatttgtaatcgtccgcgcggtagtaaactttaccgttcgcatcacgcagaataccttcatccagcagcggggcgataaatccacgctgggcatcgtcaaaatcctgacgatcgctaaacggtaatgatttggcgtaattctgattaacctgttgggtatattgagtggcggctttcgcttcctctttcgcgttagcggtatttaccatcatgccgctggcggcagttaacgcaataacaatcctgctcaaacggaataaccgagagttattcatataaatctccatttatcatttatgtcgtaaatatgtaatccatgcaaaatacgtcatttaaagctggcgttatcataattgggaaattgcgactttaataagtggaagtgtgagcggaacgcgccattttattaggcatttgtgctgaagagggaaaattacagtaaaactatcattgcagaaaataatatgagtcgttttatgtgtttattatatatattgtacctgtcgttggcacagcgggacattgcgctactgtgccaacgttttactcatggggctttagcacagaactgtggcaaaaaacgttgatgcgccaatattgctgcaccctgagcgccattaaagtcagaagatgaggcggcaataaagcgcacgacctgatgcggcagtggacggcgcaggtacttttgggtcatggcaacgagagtctcgcgtgggaaggcgggcatatccatcacgccaccgcccaggatcaccgcatcgggatcgaacagattaatgctggtggcaatggcccgtgccgcgttttcaagcagactctggacgaaaggggcgttttccgcatggacgaaaagatcgcgcaatgggtaatttcggggctgttgttcgtaccagcgtcttagcgccattccagagcaattggtttccaggcacccaggattgccacacgcgcagtgttgggtcatatctcccagggggatatgacccagttcgcctgccacaccgtgtgcacccgtccacggcgcaccgttcatccacactgcgaaccccatccccgtaccgagataggccgccagaaccagttgttgcgtaaggcggttttctactacgtcccaggagagttgcaggttaacgtcgcgggaaaactcaaccggacaattcagcgtattttcgagcttatcggcgagatcatataaatccgccgctgttaacggcaggttaggcgtagaaataatggtgcgtttatctttactgaccagcgccggaaatcccatcaccagaccatgacagcgagcgttaaagcgcctgagttgctcgtcaatcatttcgccgatacccgacaccaggccgggagcaatgacttctgcggtccgctttttttcgcagtgtagcgtttcaccttctgctgtccgcagacaaaagcggatatgcgttgcccccatatccacgcccgctacgacgttatgctgtttttgcatgaggctgtacctcgctttttgcagccagaatctgcgcggtcataattctccatgcttcgtcgatattttccgcatgattaaacaggccggaagtgccgacgataaagacatccgcccctgccgccatcagtttttcgtaagttgcctggttgcaggaaccgtccacctcaatttcgtactccagaccttctcgttcacgccatgccttcagttcggcaagtttatccagcatttcaggaatgaacggttgtccggcaaagccgggatcgacagtcatgaccgtaattttatcggccttatggatatagtatttcatggcctcaactggcgtctccgggttaaggatcagccccactttcatgtcatgacggcggatttcatcaatcaggcggaacgcctggccgttgatggtttccggatgcagagtgatgaaatctgctcccgcacgcgccagttgagcaatgtaatcctgcggccgcgtcaccatcagatgacagtcgagcggtttagttgccagttttttaacctgacttacgaagaacggtgagagtgtcagattggggacaaagtgaccgtccatgatatcgatgtggaagtaatcggcatggctgtcgataaattcgatctgttctttaaatttcagcagatccatacacattaacgagggggagattttcatgttcaattccttacttactgataagacggtcaagggcgacagccgcgataattaatccgcccatcaccaccagttggtaataggtttgtacctgcaaaatattcagaccgttgttgatggtgccgatgatcaacccgccaatcaccacagagaaaatgcgccccttgccgccgaagaaactggtgccgccaatgatggcgctggcaatggcataggtttcaaaacccataccggcaagcggttctgcggcaccgagtcgtgcagttgagacgacgcctgccagacctgcacaaacaccggagatgataaacaccaccaggatgtggaatttcacgtcaatcccggaatagaacgccgaatttttgttgccgcccagtgcgtagatgttgcgcccgagccgcatacgcgttgtcagaaaccaaaggatgagcgcgacaattagtgagaagataacggggacaggtatcccaattacgctggcggcaaagaagttcacgaagtcaaatgagaagccgtataccgagttggcatcggagatcaccagcgtgatcccacggaaaatcgcgttggtgccaagggtgatgatgaacgggtgtagccccgtccagttgaccaggcagccgttgatcgcccccagtgcgccgccaaccagtacaccgccaatcatcgctgcgagaaacgggtcaacacctgccaacatcagtttggcggtcaccataccggaaagcgccagaatcgcgccaaccgagaggtcgataccagcgaccaggatagcgaaaaactcgcccatgccgatcaataccgtcacggagctttgaacaaaaatctgggtaatattattggtggtcagaaaatattctggtgacagcgaaccaaagatggcgacgatgatcgccaggataaaaaaggtgccgtatttatcccagaacagcgcaaagttgaacggtttcttctcgctcgcttcgctttttactcttgtggtaaagcccatgccataatctcctcttcgctcatgtcatcgcgattcgtcaggatttgcgtcagtcgtccttcgcagaacacggcgatgcggtcgcagacggtgataatttcaggtagttcagatgacaccatcaggatgacttttccgtcgtccgccagttggcgcatcactttgtaaatttcggctttcgcgccaacgtcgatgccgcgggtaggttcatcgaaaataatcacttccgggcaacagcacagccatttggagatcaggactttctgctgatttcccccggagagttcggtgatattctggtttaccgaatgacatttcagcgccagcagttcgcgttgattttcagcggtacgttgctcgtcaacttcatgaaacaagcccatcgcgcctttatagccgccgtctttcagactgcggctgatcgccatgttctgagcgatggaaaagttggggaaaaaaccgttatcccggcggctttcagtgatgtaagccatcccttttttcacggcatccaggggtgaacgtggagagatatctttgccattaagacggatttctccgccagcgcgtttatccacgccaaacagacaattcatcagttcagtacgtccggaaccgaccagtccggcaaagcctaatatttctccccggcagacgctaaatgagatatcccggaccttttttctgtcacgactggtgacgttccgcacctcaaaaaccgtttcgtgcgcaaggttgctgacattctccttcatcgcgttaaaacggttttgcagttcgcggcctaccatcagacggacgatatcgtcatttgacacatcgcttactatgccgctgcaaacgctgctgccgtctttcatcaccgtatagcggtcgcaaatacggcgaatttccgccaacttatgcgagatatagacgatggccgtaccctctttacgcaactgattcatgatcagaaacagatagtccacctctttattggtgagtgaggaggtgggttcatccatgatgatgactttggcatcgagcatcagcgttttggcaatttctagcatctgcttgtggctgatagataaattcgccactttctcatctagatcaactttcaagcccacgcgtaataacatcatggcggcgcggacacgcatttctcgccagtcgataatattgacgccacagatttttttcgtcagatgacgaccaatatataaattttccagtacggttaattcatcaataacgctgagttcctgataaataatcccgataccgagttgtgccgctaatttatgatccagcttgttatagctaatgttattaatggtaatggtgcctttggtcggctcatgtattccggataaaactttcattagcgtggatttacccgcgccattttctcctagtaatgcatgtatttcaccaggataaaccgttaaattaaccgactttaatgcgtgaaccggaccaaaggacttgccgatccccgccatcgatatatatggcgtggccataaataacctctctgcacgaaatatcgtattattgcctgatggctacatttatcaggtctacgttcaggttattttgttggccggataagacacttcattagcatcatcatccggcatcattcagttttattgagtgaccaggattgaatcgaccagtttaaattccggtgctttatccagcgggataaccttgccggatttctcagcgtcaaccatcagcttcagacccgttgcgccgatatccgccgggttctgggcaaccgtcgcggtcatttgtccggcttccaccattttgcgggcttccggaatgccatctgtaccgacgaccagcacttttcccgtttttccggcgtttgcgactgcctgagcaacacccattgccatcgtgtcattcgcgcaatagatcgctttaatattcggattacgttgcaacacgttagtggcgacatccagtgctttaatgcggtcccagtcggcaggctggctggcgacaagcttgatctggcttgcttttttgaaggcttcggtggcaccattacgacgcgcttcaccggaggcgttaccggctttaccctcaatgattgcgacttcaccaccttcagcgcccaatttgtcaataatgaacgacgcgcctttcgccccgacagcaacgttatcggtggtgacaaaagcttccacattgccgccagcttttttcagattatccatgtcgattttttcatcgagattaaccagataaatgccttttttccatgcgcgggcgacaggcatgaccagattcactgaggataatggagcgaaggcgatacctttgtaatttttattactgagatcttcaaataactgcaattgagattgaaaatcgccttctgaaggagaggcaaaaatatcaacgctgacgcccagtgtttttgcttcatcttcaatgccttttttcatatctacccaaaatgggttggagagggttttcaatacgacagcatattcggcggcagcaaaagcgctggttgacaacattaagcccacgagtgtgccgctgaaatatttcagatatttattcataataatgttctcacggtaaggggacaggtaactccgcgatggcggaattacctttttcttatttcagcgcgcctggtgagaagaaatcaacaattgcgccggttttttgcatattaatattagcttgttcaatgttgagctgggcgacagagacaaaaaaagcgtccagcaaagttagttgtaatattcttgccgaggcattacgacctaataacggcgtttccggggctggtgagcaaataatataatcggccagtttcgctatcggtgaatggtagctatgggttatacaaataatctttgccccgttcttttttgccagttctacggccgcttttacatcactggttcgcccggaatgggtcactaccagcacaacatctccttcctgtaacaacgaagcggacatcatcatgatgtgagcatcaggataggcctgacagcgtacgccaatgcgcaagaacttgtgctgtacatcagcacagatagcatttgatcctccggcaccgtacaaatcccgctgtctggcctgatagaaaaagcgggcggcacggtggatctcatcaacgttgacgatcgactgaccttccataatggtgcgtaaagtgatgttaaataccttattcaccacatcctgcggcgcttcatcaaaagccaactcggaaggcaatacctgttctgactgagaaaaataatcttccagcgcactgcgtaagttacgaaagccgctaaaccccagcagctttgataccttaactatcatcgcttcagataccgccagagcttctgcgacatctttaattgcgggtgcacaactcaggttaccgggtttgagtaaccactccacgatgcggctttcattttctgtcattccttcctgcttcattcgcaggtaaggcgctaaccctataccgttcggaagcgctgaatcaaactctgactggctcatcacgttctcttgtccttgaattgaagacgccactatatcaccacagcaagaacagaaaagatgctggcgacttcacaaaaaaataaaatttataaagtttattttattgtgaacaatggcgagtggcttaaaattttatttcatttaattagtttaaaaacatgatgttatttgtttttctggttttttagatgatagatgttgctggatggtgagtgtctttaacgctattgcgctgtcagatgtaactctgtaaaacagatcaggaaggcgtaattcatcgattttgggtgtttttaattcattaacatcacaaatgttttttgattgtgaagttttgcacggacggggaagatgaatgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaacaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagcggagaaattgagattcatccactacttgcatggatgagtaatgattaatgtggatagagtttctttttgaggttggctaatgaaacgctttccgctatttcttttattcaccctgctcacgctgtccaccgttccggcccaggccgatattatcgacgacaccattggcaatattcagcaggcgattaatgacgcttataaccctgaccgtgggcgagactatgaagattcgcgcgacgacggctggcagcgtgaagtgagcgacgatcggcgcagacaatatgacgaccgccgccgccagtttgaagatcgccgcaggcagctggacgatcgccagcgccagcttgatcaggagcgtcggcaactggaggatgaagagcggagaatggaagatgagtatgggcgatgaggttgggtatggagcaggcatcgcccctcaccccaatggggagagggagaaaacgagcgcaatattcaatatcgagcacaatcggtcccctcgcccctctggggagagggttagggtgagggggccagcgcgcacattccctctcatcacgccaccccaatctccatcccatcaaaccccacctcaaaccctgacggtagtgcgttttccatcagccacgcatcaaactggtggctgatatgggtcagaatcacccgtggcgagcggataacctgattcagcgcaagcacggtatttaaatcacagtgattacgcggtgcatccgcgcgcggcgggtgactgcaatccatcaccattacctgcggctgattattgcgtaaaaatttcagcgttttttccggcaagcctgcggtgtcagacagccacgccacccggctgtgtgccgtttccagcagataaccgaaggtcagttttgagtggttgagcggcaggggcgtgacctgtaacccctgcaaatcaaacaccacaaacggttccaccgtgtggctgaaatcaagcaggcccggatgtttaaacagatcgtcgcagccctgttcatccggcgggccgtaaaccgggatcggatcgccaacgccccagcgcagcggaaacagcccctggacgtgatccatatgataatgcgtcagcaaaaactgctggaacgatccgggcgaccagcgatcggcgagatcgtgcagcccggcgtcgatcagggtgattgcgtcgttaaacttcactacgccgctgcacggttggcggcgatactgcggcgagcgccgcgctctggcgcaggccgcacactcgcagccccatgccggaacgccctgtgcgccgccggtgccggtgagcgtgagggtcaggctcatgttacagcgccttggtgaagcggaagtggctctgctcgtagccttcgcgcagatagaaacggtgcgcgtcgtggcgcttcacgttggtcgaaagttcggtcatttcggccccggcctggcgggcttcttcttctgcccacgccagtaacttactgccgacgttcagaccgcgcgcctgcggcattaccaccaactcctgaatttcgccgatccagttgacatgatgcagatgaaactgcaaatgcaggccgatcatgccgacaacttcgccatcaagcagcgccagatggtagcgcatgtttgggtcgcgcagattggcgttaaaacccacgcgaaacgcgtggtggtcaaactccgcctgttttagctcacaaatcagcgcgtaaaccgcgtcggtgtcgtactgcgtggccgggcgaagctcacaagcaggcatggtgtttctccttctgatggatcagcgtcagcagcgtgtcgaccgactggcgcaggctgccgtcattgttgagcgtatggcaatcctgtggagtatagcgggcggcgcgcgccaggcgggcgttaatttcactggcgttttcacggccacggttttccaggcgctggcggaggatctccggcgaaacctgtaaacagacgggcagcagcgccgattgatagcgcgcccgcgcctgcggcagatgggcgcgtgagccgttgaccagcacgtcgaatccggcgtgcagccagagatcaatctcgacgccgacgccataatacagaccgttagcgtgccagcttaaggccaacagattttgccccgcgcgggtaaaaaactcctgctcgctcagggcgatatggttttcacttccggcgctggcatcgcgcgtgatgtagcgatgcgccaccagtaactgagtttgttcccgcaggcggagttccgccagcaggctgtctttcccggagccggacggccccattaaccaaatcagttttcccatcatcagaacacccttttaccctgacgccagacgtggtcgatatgaatatgattgtccttgcgatgcgccagcaccaggtcggcgcgtttgccctcgccaatcaccccgcgatcctggagattaagcgcctgcgctggatttttagtcaccagcttcaccgcctgcggcagcgtaaagcggttgctctggtcatcggcgacgcgaaatgccgcatcgagcaggctggcggggtagtagtcggaagagaggatatccagcaggccaagctgcgccagttcactggccgccacgttgccggagtgcgagccgccgcgcacaatattcggcgcgcccatcagcacgttcatgccatgcttgcgcgaggcttccgccgcttcgaacgtggtgggaaattcggcgatcacgctgccaagctggtgagattcagcaacgtgggcgtgggtggcgtcatcgtggctggcaagcgcaatttttcgcgcgcggcacagggcggcgatggattcgcgattcggctgcgaccagcgtgcggcgagcgccagttgctcttcttcgtactgctgcatctgcgcatcagtgagggagtatttgccctgataatattcgcgatacttctcgcggttggcgaactggcgctggcccggcgagtggtccatcagcgacaccagcgtcaccggctcgcgctgcaccagtttttcaaacagcggcagcgtggtgtgatgcggcagttcgcagcgcagatgcagacggtgctcggcgcggttgacgccgcgtttctgcgtctcttcgatggcgttgatcatcttctccagattctccagccgatcgccgccgtcgcgcacgtcgccaattgccacggcatccagtacggtggtgatgccgctcgccaccatcagcgcgtcgtggctgctcatcgccgagtgggcaggccagtcaactttcgggcgcggggtgaagaatttatccagattatcggtatgcagctcaatcagccccggcagcagccagccgccttcgccgtccatcgcctccggcaggcggctctggctttcggcaaaggcgcggatttcgccgttctgcacctccagcgaaccgcttaccacctcgttttccagcaccagcttaacgttattgataatcatgaagaggctcccattgggtgcaggcggtcggcgacgtcattacgtacagcttcgtcatggaagatgcctacgatggctgcgccacgggttttggcttcgcgaatcagttccaccaccgcggcgctgtttttggcgtccagcgaggcggtaggttcgtcaagcagcagaatggggtagtcgacgataaagccgcgggcgatgttgacgcgctgctgttcgccaccggaaaatgtcgatggtgccaggtgccacaggcgttccggcacgttcaggcgggtgagaagacgcgcggctttagcggcgcaggcttcacgcggaacgccggtatcgagcagcggctgcatcaccacttccagtgctgagatacgcgggatgacgcgcagaaactggctcacccagccgacggtggttttgcggatttccaccactttgcgcgctggcgcggtgaccaggtctacccactcgtcaccgtgtttgatctggatttgaccttcgtcgggcagatagttggcgtacagcgagcgtagcagagttgatttgccgctgccggaatggccgtggagcaccacgcattcgcccgcgttgacggtgagcgaggcgcgattgaggacgggcaggcgcacgccgttttgctggtgcaggatgaaggttttactgacgttttgtacgttaatcatttttcgcctcgtggttcgggtgtcggatgcgacgctgacgcgtcttatccgacctacggggagcgcatttgtaggccggataaggcgtttacgccgcatccggcaccggctcaattctgcaaaaccgatgacaccagcagctgtgtatacggatgatgcgggtcgtcgagcacgcggtcggttaacccactctccaccacttgcccctgcttcatcaccagcaaacggtccgccagcaggcgggcgacgcctaaatcatgggtgacaatcaccaccgcgaggttcagctccaccaccaggccgcgcagcaggtcgagcaggcgggcctgcaccgacacatccagcccgccggtcggttcatccataaacaccagcttcggatgcgtcaccaggttgcgggcaatctgcaaacgctgctgcataccgccggaaaaggtggtcggcaggtcgtcgatccggttggcgggaatctccacctcttccagccacttctgcgcggtggcacgaatatcgccgtaatgacgtgccccggtcgccatcagccgctcgccgatattgccgcctgccgacacctggcggcgcaggccgtcgagtggatgctgatgcaccacgccccattcggtacgcagcaggcgacggcggtcggcctcgctcattgcatacagcgaacggttctcgtagtgaatttccccctgctgcggcgtcaggcgcgcggagatcgacttcagcagcgtggtcttcccggagccggattccccgacaatgcccagcacttcccccggccataaatcaaaagagacatcgctaaagcctttgcccggcgcgtaaaggtgggtcaggttattgaccgaaagtaacggttgattcattggttttttgcctcgctctgttggcggcaataatcggtatcggagcagacaaacatgcggtttccggcgtcatccagcaccacttcatcaagatagctgtgggtcgatccgcagatggcgcatggctcatcccactgctgaacggtgaacgggtgatcgtcgaaatcgagactttccacgcgggtaaacggcggcaccgcatagatgcgcttctcgcgccccgcgccgaacagttgcagggcgggcatcatgtccatttttgggttatcgaatttcgggatcggcgacgggtccatcacgtagcgcccatttaccttcaccggataggcgtaggtggtggcgatatgaccgaagcgggcgatatcttcatacagtttcacctgcatcacgccgtactcttccagcgcgtgcatggtgcgggtttccgtttcgcgcggctcgataaagcgcagcggctcggggattggcacctggaagataattatctgatcttcggtcagcggcgtttcggggatgcggtgacgcgtctggataaccgtcgcatcgtccgtacgttccgtggtgtttaccccggtcacgcgcttgaagaagttgcgaatcgacacggcgttggtggtgtcatccgcgccctggtcaatcaccttcagcacgtcgctttcgccaatcacgctggcggtaagctgaatgccgccggttccccagccgtacggcatcggcatctcgcgcccgccaaacggcacctgataaccggggatcgccaccgcttttaagatggcgcggcggatcatgcgtttggtctgctcgtcgaggtaggcaaagttgtagccgctcagattagccatggttctgctcctgttgcagacgtttgagtagctccagttcggcctggaaatcgacgtagtgggggagtttgaggtgtgagacaaagcctgcggcttcgacgttgtcggcatgtgccagcacgaactcttcatcctgcgccgggcctgtcgcgtgctcgccgtactccggggcttgcagagcgcggtcgaccagcgccatcgccatcgctttgcgctcgctcatgccgaacaccagcccgtagccgcgcgtgaagtgcggcggctcacccggcgggtcgataaaaccgttaaccatttcacactcagtcatcagcagttcgccgacgttcaccgcaaatcccagctcttccggcacaatcgacacgtcgatatagccgctgcggatctcgcctgcgaacgggtgattgcgcccgtaaccgcgttgggtggagtaggccagcgccagcaaatagccttcgtcgccgcgcatcaactgctgcaaacgggaggagcgtgagcaggggtaaaccggcggcgtgcgggtgatgtcatccggctgtgcgccgctatcctcttcaaacttcgccagcccctgacgcgccagcaggctgaaaacgtgcggcgacggctgctgttcgctgtcggcggtggtcagcgtcggcgcttcgccgtttgccagcagggtaaaatcgagcaggcgatgggtgtagtcgtaggttgggccaagcagctggccgccgggaatgtctttataaacggcggagatacggcgttcgagacgcatcccggtggtgtcgagcggctcgcttaccgccagcttcgccaacgtggtgcggtaggcgcgcagcaggaaaatcgcttcaacgttatcgccgctggcctgtttcagcgccagcgccgccagttcgcggtcggcaatgccgccttcggtcatcacgcgatctaccgcgaggttaagctgctgttcaatctgggcgacgctcagttcgggcaaatcggtatcgcctcggcgtcggctctcttgcagggcgtgggcggcgtcgatcgccttctcgccccctttcacggcaacgtacatcagcacacctccacatgagtggttcgcggaatagccagcaggcgctcgccacaggtcaggatcaggtcgatgccgagcgggaacggatgcgggcgctcggtgagttcgtgcagaatgcactccggcagctgcggagcgatcattcgttcttcggcaatacccgcaccagtaaggcgcaacatgcgtccgccgctcaggctggcgacctgtaaaatcagcgtcgcacccgcttccggcgcaacggcggtgccggtggaaagggcgttgagctgttcgctggaaatcgcctcatccgtcaccgcgaaggtcgcctgttccggctggctgaccagcggcgcgttggtatgaaaacgcaggctctggttgacgatatcgttatttaatggggtagaaagccacaccggcgtgtcgttatcggccagcgtcagcagcacgctggtggtggcgatattcagcggttgccagccgcgtttgagctgatgcagggcgacaatcacgcccggctcgctcatggcctttaacaggcgacgaaaactgtgctgggcatcctgcacgggaagcataaaagcggtttccagggtcatgcgttgtctccgcgaaccatcgtaaagaagtcgacccggctggcgttcacttcggcctggcgtgcggcaatgcgtgccatacggtcagcgtccagcggggcaataagggtttctgataagttttgaaagtggcgagattgctgcatcagcgcgtcaatcagcgcgcagcgttcggcgtgctgtttatcacgcccctgcacccagctgtagccgagcgtgccgtcagtcaggcgcacggcggcgcgggtcagcgtggcgtcgccggcaaaaaaacgttcgccggtgccgcccatccgcgcctgaatctgtaccaggccagtttcagcggcgcggatcacctcatagtcggcggtgatgtttagcgcgttcaggcgtgctgccagttcagccggttggctgtgcgccagcacggacatccagtgctggcgggtcgcggtatctgcgtgcattcagtgctccatagtgaattcaatcatgtcggcgcgcgtcaggctgacggagtactccgccgggctgctttcaccgtcacggtggttaagggtgcgcacgcacagcagcggcgacatattcgggatttcaagacgctggcactctttggcctgggcgcggcgggcgctgatccgcgtctggctgcggcgcagcgcaattccggtttgctcgcgcagaaaatcgtgcagcgagccgctgtcgaagcgttgcagcgtcggccagagggtgaggtccgcgaagtagtggtcgattaaacagagcgcgacgccgttgacacgacgcagggtgcgcaggtggatgacgttctccccctcggtaatccccagtgcgtcagcgacgtggccggacgcggggcgcaataccgaaagcagtttttcgctggtgggatggctgccctgatccagcagattctggctaaaacgcgcctgggcgttgagcgggtaatcgaacgggcgcatcagcaccagcacgccgacgccctgacggcgctgtacccagcctttttccaccagttggtcgatggcgcggcgcagggtgtggcgattcacctcaaagcgcgctgccagttgctgctcggcgggaagatagtcgccgcagcggtagtgttgacgaagctcctgctcaagttttgcggctatctcttgatagcgtgttgggtagctggtcggatgtgtagacaagtgcatagatatcaatgcctcgcttatcagataaagtgcttacgcaaccgttgagagaggaaatccagcaggctgaccgtgacgatgataagcaccatcagggcgcaggtttgttggaactggaaaccgcgaatcgcttcccacagggtgacgccgatcccgcctgcgccgaccatgccgacgacggtcgccgagcggacgttggattcgaagcgatagagggagtaggagatcagcagtggcatcacctgtggcagcacgccgtagaggatctcttcgagcttgttggcaccggtggcgcgaatgccttccaccgggccgggctcaatcgcttccaccgcttcggaaagcagcttggagagcacgccggtggtgtggataaacagcgccagcacgccagcacgccagcgaacgggccgaggccgacggcgaccacgaacagcatggcgaagaccatttcgttaatggcgcggcaggcgtccatcaggcggcgaacgggctggtaaacccaccacggcaccaggttttcggcgctcatcaggccaaaggggatggagagaaccaccgccagcgcggtgccccagacggcgatttgcagcgtgacggccatttcggtgaggtaatcctgccactggctgaaatcgggcgggaagaagtcggcggcgaacgtcgccatgttgccgccgtctttgatcagcgtaagcggggccatttccgcgccctgccacgagacgaccaacacggcgagtacaacggcccagctcagaagcgagaaccagctgcgcttgggtggggcgatggtgatggtttgcatgtttggctccggtctgtaggccggataaggtgcttgcaccgcatccggcatcaacgcctgcacattgtcggatgcgacgccggggcgtcttatccgacctacgatttactgcaccgctttactcaccgaactcatcgcgcttagcgcgttgttcaggcggtccaggtcatccagctgcgcctgaatctcggtggtttttgccagcttgtcctgctcattcagtcctttattgcttttcacgccctgcatctctttaaacagcgcgagctggcgaatcggcaccagttgcaggtcgctggaagcgcggaatggcgcccagcccaggcgttccagcaccgctttttcttccggcgttttgccgtagttcataaagaagtcgtagatcttgtctttggtggtttcggaaagattcttgcgccagacgatcggatcgcctgggatcagcggcgacttccagatcaccttcagttctttcagcttctctggcgcggaggttttcagcttgtcgaggttttcggtgttgttggtggcaacatccacctgcttgttggcgacggccagcgcgttggtttcatgcccggcgttgacggtgcgcttgaagtcgctggcggagatattgtttttggcgaagacgtagtagccggggacgaggaagccagaggtggagttaggatcgccattgccaaaggtgagatctttccgcttcgccagcagatcgttcaggttgttgatcggactgtctttgttgacgatcaacacgctccagtaacccggcgatccatccgccgcgaccgtctgggcgaagacctggccattggcgcgatccaccgcttccatcgccgacagattgccgtaccaggcgatatccactttattgaagcgcatcccctggataatgcccgcgtagtccggggcaaagaaggcgttgaccttcacgcccagcttcttctccatatcctgcaagaacggcgtccattgcggtttcaggttttgctgtgattccgttgaaataatgccgaaattcaacgccttttcctgctcttcggcgtgcgccgggcttaacagggtgctgaggctgaacatgctggtgaaggccagcgaggcaattatcttagcgttcattcgttttcctcaatgatggggatgtcaggcagctttcgcgttctcttcgacgcggttaatgctgcggtagagatggtcaaaacgttcgttatcaaactgttggctgctgccgtcgtagaagacgtgcccctggcgcagggcgacgatgcgttcgcagtagcgcagggcgtaatccacctgatgcagcgtgacgaccacggtgatgccgtcgttctggttgatgtcgcgcagggtgtccatcacgatgcgcgctgattctgggtccagcgaggcgatgggttcatcggccagaatcactttcgcctgctgcatcagcgcacgggcaatcgccacacgttgctgctggccgccggagagggtggaaacgcgctgatgggcaaaatgcaccatgccaacgcgggtcagcgcctgtaacgcgcgctgtttctgctcgccggtgaaccagctaaaacaggtgcgccagaacggcgtgctgccgagcgcgccaatcagcacgttctccagtacgctcaggcggttcaccaggttgaattgttggaatatgtagccggtatgggcgcggcttttgcggatatcgcgggccaggcggccttcgcgctggactgtgcggcccagcagctcgatatggctaccgacagatttatcgccggtaatcaaaccgcttaagtgacgtaaaagggtggattttccggaacccgacggcccaagcagagccaccatttcaccgtgatgaatgttcagatcaaccgcatgcagcgcctgatgctgattgaaggttttggcgagcttctcgacacggataatcgtttgcatgatgcagcctccctaaaaaagtggctccatcgtggcggattattgtgacgatttggttaattaaaagtgactaacagatgaagagttaacgggaattcgatgacagtgcgggagggcgggcctcccggcgggttattgcgttggttgttgtttgacgacattaatcatccacggtacgccaaatttatcggtgactttgccaaagccatgcgcccagaaagtttcctgccaggccatttcgatttttccgttagcggcaagattgtcaaaccagcgttttccttcttcgacctgttgcgaatcgagcaccagcgtaaagccggagtagctggcttttcctgacggcatggcatcgctcatcatgatgtcgcttccggcaatgcgcacattggcgtgggcgatggcggtatcgggaaattgcattccggaagggcagttctcggcgctgtcctgcgctgattttggcatttcgccgaagctgattttatagagcagttccgcgcccaacgtacgttgataataggcaatcgcgtcggaacagttaccggcaaaagagaggtagggacttaacggcatgatggtgacctcagttaagagaagccagttaagtgtagttcgaaatttatacagatgagaggcggcctgataagacgcgcgagcgtcgcatcaggcagtcggcactgttgccggatgcggcgtaaacgccttatccggcctacggagggtgcgggaatttgtaggcctgataagacgcgcaagcgtcgcatcaggcagtcggcaccattgccggatgcggcgtaaacgccttatccggcctacggagggtgcgggaatttgtaggcctgataagacgcgcaagcgtcgcatcaggcagtcggcaccgttgccggatgcggcgtaaacgccttatccggcctacggatggtgcgggaatttgtaggcctgataagacgcgcaagcgtcgcatcaggcagttggcactgttgccggatgcggcgtaaacgccttatccggcctacggagggtgcgggaatttgtaggcctgataagacgcgcaagcgtcgcatcaggcagtcggcaccgttgccggatgcggcgtaaacgccttatccggcctacggagggtgcgggaatttgtaggcctgataagacgcgcaagcgtcgcatcaggcatctggcaccgttgccggatgcggcgcgagcgccttatccggcttaccgatcacaatacaatcagttctttttcacaaactcagatttcagtttcatcggaccaaaaccgtcgattttgcaatcgatgttatggtcgccttcaaccaggcggatgtttttcactttggtgccaattttcagcatcgaagagctacctttcaccttcagatctttaatgatggtaacgctgtcgccgtcagccagcagattgccgttagcatctttaacgatcagctcgtcgctttcctgtgcaggttctgcgtcgttccattcgtaggcacattccgggcagatgtacatgccgttatcttcgtaggtgtattcggagttgcattttgggcagtgtggtaatgacatgtggatttcctcaaaagtcagcagggcaaaagcgccaaaaaacggcagattgccgaaaaaggccgcaattatacacaaaatccctgagtttgtcgggggtactgctgattttagacgacgatcgttttcatttgaaaggaaacgcaaaaagaaaataatctttttgcctctatttattatttaagataatgttaatgctctacttgttctttttttaattcacatgatatttttatctttctgacgttttaaacgtatcagaagacgttatttattctgataaaaaacaacacactaaatataaaattatttcttgcagtaattataaaagccgaaaacagaactcaaaaacaatctggctaaataaaataacaaaatttgctttaaggaagaattttctatgtacacacagaccctgtatgagttaagtcaggaggctgaacgcctgttacagctttctcgccaacagttgcagttactggaaaaaatgcctctctctgtacccggagacgacgcgccacaactggctttaccctggagtcagcctaatatcgccgaacgtcacgcgatgctgaataatgagttgcgtaaaatttcccgactggaaatggtgcttgcaattgtcggtaccatgaaagcagggaaatcaaccaccattaatgccattgttggtacggaggttctgcctaatcgtaatcgcccaatgactgcgctgccgacgcttattcgccatacgcccgggcaaaaggaaccggtactgcatttttcacatgtcgcgccaatcgattgtttaattcaacaattacaacagcgcctgcgtgattgcgatattaagcatctgaccgatgtgctggaaatagataaagatatgcgtgcgcttatgcagcggatcgaaaatggcgtcgctttcgaaaaatattatctgggtgcccagcctatttttcattgtctgaaaagtttgaatgatttagtgcgactggcgaaggcgctggacgtcgattttcctttttctgcttacgccgccattgagcatattcccgtgattgaagtggagtttgtccatctagcggggctggagagttatcccggtcagttgacgttactggatacccccgggccaaatgaagccgggcaaccgcatctgcaaaaaatgcttaaccagcagctggcacgcgcctcggcggtactggcggtgctggattatacgcaactgaaatcgatctccgatgaagaggtccgtgaggcgattttggcggtggggcaatcggtgccgctgtacgtgctggtcaataagttcgatcaacaggatcgtaacagtgacgacgccgaccaggtgcgggcactgatttccgggacgctgatgaaaggctgtattacgccacagcagatatttccggtgtcgtcgatgtggggctacctggcgaatcgggcgcgctatgagttagccaacaacggtaagttaccaccgccagagcaacaacgctgggtggaagattttgcccatgccgcgcttggcaggcgctggcgtcatgccgatctggcggacctcgaacatattcgtcatgctgccgatcagttgtgggaagattcgctgttcgcccagccaattcaggcgttgcttcatgccgcttacgctaacgcctcgttgtatgctctgcgatctgccgcgcataaactgttgaattacgcgcagcaggcgcgggaatacctggattttcgtgcgcacgggttaaacgtcgcttgtgaacaattgcggcaaaatatccaccagatcgaagaaagtttgcagctattgcaactcaatcaggcgcaggtgagcggcgagattaaacatgaaatcgagctggccctgacctccgccaaccactttctgcgtcaacagcaagatgcgctgaaggtgcagttagccgccttgtttcaggatgattcggagccgttaagcgagattcgtacccgctgtgagacactgttacagacggcgcagaacaccatcagtcgcgactttacgctgcgttttgccgagcttgaatccaccctttgccgggtgttaaccgatgttattcgccccattgagcaacaagtcaaaatggaattgagcgagtcagggtttcgtcctgggtttcattttcctgtttttcacggcgtagttccccacttcaacactcgccagctgttcagtgaagtcatttcgcgccaggaagcaacggacgagcagagcacgcgtttaggcgttgtgcgtgagactttttcgcgctggttgaatcagcccgactggggacggggaaatgagaaatcaccgacagaaacggttgattacagtgtgttgcaacgagcattaagcgcagaagtcgatctctattgccaacaaatggctaaagttctggcagagcaggtcgatgaatctgttacggcaggcatgaatacttttttcgctgagttcgcttcatgtttgacggaattacagacgcgtttacgcgaaagtctggctctgcgtcaacaaaatgaatcggtggtcaggctgatgcagcagcaattgcagcagactgtgatgactcacggctggatttacaccgacgcccagctgttacgcgatgatattcaaacacttttcacggcagaacgatattgaccaagacgttacttgacggccccggtcgcgtgctggagtcggtttatccccgctttttagtggatctggcgcagggtgatgatgcccgccttccacaagcccatcagcagcagtttcgtgaacgactgatgcaggaacttctttcgcgtgtgcagcttcagacatggacgaacggcggcatgttaaatgcgccgcttagcctgcgtctgacattggtggaaaaactggcgtcgatgctggatcccggtcatctggcactgacgcagatcgcgcagcatctggcgctgctgcaaaaaatggatcaccgccagcactctgctttcccggagctcccccagcaaattgccgccttgtatgagtggttttcagcccgttgtcgctggaaggaaaaggcgttaacgcaacgaggcctactggtgcaggcaggtgatcagagcgagcaaatttttacccgctggcgtgctggggcgtataacgcctggtcgttgcctgggcgctgttttatcgttctggaggagttgcgctggggggcatttggcgatgcctgccgtctgggaagcccgcaagcggtggcgttgttgctgggtgatttgctcgagaaagcgacacaacatctggcagagagtatcaatgcggcaccgaccacgcgtcactattaccatcagtggtttgcctcttcgaccgttccgacgggcggggagcatgctgattttttaagttggctgggaaagtggaccacggcagataaacaacccgtttgctggtcagtgacccaacgctggcaaactgtcgcgctggggatgccacgactctgttcagcgcagcgtctggcgggggcaatgctcgaggaaatcttctctgtaaatttggcgtaaataatcagttacatcaatgagtcctaaacgaaatccatgtgtgaagttgatcacaaatttaaacactggtagggtaaaaaggtcattaactgcccaattcaggcgtcaactggtttgattgtacattccttaaccggagggtgtaagcaaacccgctacgcttgttacagagattgcatcctgcaattcccgctccccttttgcggccgtcgcgctgatttttctggcgtttgcggaaatgggccaactctgcgaggaaagctatgctgaaaaggaaaaaagtaaaaccgattacccttcgtgatgtcaccattattgatgacggtaaactgcgtaaagccattaccgcagcatcactgggtaatgcaatggaatggttcgattttggtgtttatggttttgttgcttacgcattaggtaaagtttttttcccgggggctgaccccagcgtgcagatggttgctgcacttgccactttctccgttccctttctgattcgaccgcttggcggactcttctttggtatgttgggcgataaatatggtcgccagaagatcctcgctatcactattgtgattatgtcgatcagtacgttctgtattggcttaataccgtcctacgacacgattggtatttgggcaccgattctgctgttgatctgtaagatggcacaaggtttctcggtcggcggtgaatataccggggcgtcgatatttgttgcggaatactcccctgaccgtaaacgtggctttatgggcagctggctggacttcggttctattgccgggtttgtgctgggtgcgggcgtggtggtgttaatttcgaccattgtcggcgaagcgaacttcctcgattggggctggcgtattccgttctttatcgctctgccgttagggattatcgggctttacctgcgccatgcgctggaagagactccggcgttccagcagcatgtcgataaactggaacagggcgaccgtgaaggtttgcaggatggcccgaaagtctcgtttaaagagattgccactaaatactggcgcagcctgttgacatgtattggtctggtaattgccaccaacgtgacttactacatgttgctgacctatatgccgagttatttgtcgcataacctgcattactccgaagaccacggggtgctgattattatcgccattatgatcggtatgctgtttgtccagccggtgatgggcttgctgagtgaccgttttggccgtcgtccgtttgtgctacttggtagtgttgccctgtttgtgttggcgatcccggcgtttattctgattaacagtaacgtcatcggcctgatttttgccgggttactgatgctggcggtgatccttaactgctttacgggcgttatggcttctaccttgccagcgatgttcccgacgcatatccgttacagcgcgctggcggcggcatttaatatttcggtgctggttgccggtctgacgccaacgctggcggcctggctggtcgaaagctcgcagaatctgatgatgcctgcctattacctgatggtagtggcggtggttggtttaatcaccggcgtaaccatgaaagagacggcaaatcgtccgttgaaaggtgcgacaccggcggcgtcagatatacaggaagcgaaggaaattctcgtcgagcattacgataatatcgagcagaaaatcgatgatattgaccacgagattgccgatttgcaggcgaaacgtacccgcctggtgcagcaacatccgcgaattgatgaataagctgaaacggatggcctgatgtgacgctgtcttatcaggccaattgaactcttaaggttcacttaatctctgacgcgcatactctcctccaggttaacggaggagagtgcaatgaaaaaccgtgtttatgaaagtttaactaccgtgttcagcgtgctggtggtcagcagctttctttatatctggtttgccacgtactgatctttcttcagccgtacccaggcccgcgtgccggaagtctcttgccggttttgcaggaaaaactgcccgtgatgcaactgtgtaatgcggctgacaatacttaaccccagaccaatcccgccataacggctgtccatacgtacaaacgctttactcaactccccgcatttactctcatcaatacctggtccttcatcttcaactgccatgaccgctccgtcatcttcttgcagcttaatcataatgttgctgccttgcgggctgtaacgatgggcgttttctaccaggtttcgcaataacatccgcagcagggttgcatcaccctgaacggtgatgtcggcggcgctctctggcaatagcagggtttgctgtcgctggtcgagcatggtactgagttcgtcatacgaggggagaatgacatcttccagcagttttacatgttgataattaccggaagaaaatgactgtccggcacgcgccagttgcagcagctgggagacgctctccatcatctgatcaagccgtgccactaacggtgctacatcaatgtgatgcgttttcgccagcagttccagatgcaaacgcacccccgccagtggcgttcgcagttcgtgcgcgacgtcagcggtaaacaacctttcgttatccagcgtgctggtcaggcgactgaccagatcgtttaacgccgaaaccaccgcttcgatttcgagggtggcgctgtgaatggcaatgggcgttaagttgtcggcggtgcgcgcttccagctctttttgcagctccgccagcgggcgggtgatgcggcgtaccgcctgatagcagataaatagcgtcaggctgaccataaagacgccggggacaatcaggctggcgaccgcctcgcggatctcacgcatgatgtggcgatcgttgttgcgattgtcgcgtagcgcctgctcaaacagctgaatctgctcggtactttcatgccatagccagaagacgctgatcagctcaaacaccaacaaaatggccccgatggtcaatatcagccgttggcgcagcgatattggtcggcgcagaaaatgcatcagattcaattagttttcctcattcgcgaccagcatatagccaaagccgcgcacggtgcggatacgggctttgcccactttgtcgcgcagattgtggatatgcacttccagggtgttggtcgagggttcattgtcccagttatagatgtcgttgtagagaatttcccgatgcaccggactgcctgctttgagcattaaccgtgacagcagagcatattctttgggcgtcagaatcaactcttcaccgcccatccatacctgacggcgacccatgttcagcgtcagattgccaacaatcagctcactttcgccctgattattatggcgtcgtagcagggcgcggatacgggcatgtaactcttccagcgcaaaaggcttcaccagatagtcgtcggcaccgacatccagcccggcgattttgtcggtcagcgtatcgcgagcggtgaggatcagtaccggcagggtatattttttctgccggatacgggcgagaaaatgcagtccatcttcgtcgggtaaccctaaatccagtaccaccaggctgtaatgacctgcctcaaggctttgttccgccatccgcgcggttgtcacgctatcgcacgcgtagccttcggtttgcgccgccagaatcagtccctgcaataacagcgtatcgtcttcaacaatcagaattttcattcactcactctcctgcaagtttgcagaatatcatccgcagcctggtaatacttcgtctcaacgccagttaatcccaatagcgtggagaataaattgtcttgtgaatagtgttgcgtttgcgcctgtttttgcaggcagttctggtcaacctgataccgtttttgataatcctccgacagccacagcagcatcggcacctgtttttggctatccggggcgatggcataaggcagaccgtgcagatagatgccattttcacctaacgattcaccgtggtcagaaagataaaccaggctggtggtaaatttatcctgatgttctttcagcagattaatcgctttatcaacaatatagtcgacgtaaaccagcgtgttgtcgtaagtgttcaccagttgctctttggtacaggtctggatctcattggtgtcgcaggttggggtaaatttcctgaactgaggcggatagcggttgtaataggtcggaccgtggctgccgatggtgtgtaagacaatcacgccatcaccttgcaggttattgatgtactcttcaagcccgtggaacagcacttcgtcatagcattcgccgttgatgcactgatcaggtagattcagcgcggtgacgttctggtgaggcacgcggtcgcaggcacctttacagccgccatcgttgtcattccacagcacgttgatgcccgctcgctgaatgatatccagcacgccttcctggtgctgtgccagctcttctttgtagtgctcacgcggcatatccgagaacatgcacggtactgaaactgccgttgccgtgccgcaagatgcggtattagggaaatagaccacgttatctttcgccagccgcgggttagtttcacgcgggtagccgttgagggagaagttctccgcccgcgaggtttcgccgacaatcaggatggtcaaatttttacgtttttcgttctgcattaacgggttgcggtgcgcgtcttcaccaattcgcaccagcggcagatttgccagtcgctgatgggagtaccatgaccagctggcaacaatgctgttagaggggcttaaggatttcaccagctctttgttattgcggaacaacgaggcgtagtctttataaaacagtgcggcgaccagcaaaatcagtagtacagaaaccagaatattggctccacggaaaagaacactgcgcagacgcgaggtggcaggtttgatttttatccagcaggcaatcagcgcagcaagcacgccgctgaatcccagcgttaataacatttgcggtgtcatcagcgcataactttctgccggagtggtatcaataatattggcaatcatcgagcggtcgatgacgatgccgtaagtcattatgaaatattgtgcagccgcgccaaccagaataaacaggcaggccagtggtcgattaagccataagaaagagcttagtgtcaggacaatattaatcacgctgaaagcgacgaccggcatcgacaagaaaaccagtacgttatgcagcgaatccagcggcagcgcctgcaacacctgtttaaaaaaggcaatattcaggcagatagagatataaaaagcggccaacaatagccaggcgagtaaattcaaagagggtctttttagtaggcgcttcaacatcacggtgtttccatcgaacaaagtgcgcatatgctcgcaaagcaaaattaagccaaccttaagttcttaaggttggcttttatgtttgctggattaaggggaattaatctttgcttattggtgcatctaagggatacgggtttttatgtagccggttgtaattcagcgcatacatggcggtgatgaccatcagggtgacaaatgaccacataacctctttcgctccggaccccaccacggcccagatgcagtagaggaaggcaatggtagtaactgccagatatgccgggcgtgctttaccaaagtgaccgtgtccgagcagcagtaacgccgcacaggtgtaaagatatggcaccagtgtaaagatgaccgagacggaagaaaccagaccgaactctttggtcgcgtttggtgaaatgctgctgagctggaagatggtcatcaaaataccgacgataatcagccccgccactggcgtacccgctttatttacacgggcaaaaatcggtgggaacagtccgtcatcggcagcggctttcgccgtttgacccgccagcaacgtccagccgcccagtgaacctaagcaacccgcagctgcgcagaaggaaacaatggccccggcggtgtcacccaacgccatccgtgcggcatcaccgaatggcgaagcagaaacgcgcagtgcggcattagggatcatccccataatcgcggtggtagaaagtacatagcaaacggcggcaatcaataccccaccaatggtggcgatagggacattgcgtttcgggtttttcaccacacctgcggcaacggaggcactttccacaccgatgaacgaccacagcgtaacgttaagggtactttgaattgcaccgaaggtgcccaggccgctgacgttccatgccgccatataggtttcaccacggaaccagaaccagccaaatacggcaatcccgacgatggggatcagcgccagcacggtggcaactgcctgcacacgggtgatcattttcggaccgacaatgttcagcaggacgaagatccacagcaccacgacgcaggtgatggttaataccaatggatctttcagaatcgggaagaagtaacttaaatatcctacgccaatgaccaccatggcgatattgccgatccagcaggccagccagtagaggacgttggtttgataaccgagaaacgggccaaagcagcggcgggcgtaagcgtaagaaccaccaggacttgggtcgaggaacgacattttggcgtataccatcgagagccccagtgcaccgataatcgtcaccaaccatccataaatggcaatcccgccagtagaggccaggtttgcaggtaacagaaaaacacctgaccccataatattccccgacaccatcagggtgacggggattaagcccactttgtgagcatcagcatccgaagacataattaaactcctgcgaaggcgagcttcgtgacaataaattacgtcatatcatacgcctgcattcgatagttgaattattatcgaccgggttatcgctgatgccgttattaatatagctcttcgttaaggttaaaaatcaggcgacagtgcgttctctgtgctgactaacataatgcagcggcgtcataccgtagaagtctttaaagacagaaataaagtacgacgtactgttgtagccgcaggactgtgatacctgagagatatttttaccgtccatcattaattcatttacggcataacgcatgcggcaggtggtgattatttggctataactggtgttttcgcttttcaactttttctttaacagacttgggctaagacataaacaactggctaccatactaagattccagtctttgtgaatatcgctttcaataatttgataaacgctgtcacttacacaattacgtaacatatacatcattaatgaaacgaattttttactgtcgagaaaacgggatagcaccgtgaataataatgcgcgtgttcgttccttttctgactcagtttctgcgggcatcatgctgtgttgcgcggcaacgcgaaagacgtctggcgtcaggcatggcagggtgagtatgggcgtagcgctacgttgccatactggtatttgcgagagatctttattcagaaaccggaggtaatctttgatgatgtcgtgactaatatgagcaaccaaagtgttgttaagagaggagacgtcgataatattattttcacaatttaataacgccatatggttagctttaaggctaataggttctttcccattcacccttatccagacatctttttcagtcaataaaacaatacaaggttggtcgctgcaaatcctcatacatgtactcctgagtgcgaataaaagaccagttctcgctaaagcaaagcgataccgggaaatggttatataattgtatgatgaatataaacatgcataaaaataacgagttttactaatagtacaaatttttatagtaatttctcatgtacatatttttttacaggataaataacaggcaaaaaaaagcgcggggtggggccgcgcaaaaagtatgacatttttgtttgcagcaatttttatgaaaacgttgccatactcaaaaggcctaaggccaggcggcgtaatgttatttaaacaattacgccttcagcggaatagtggttacgctttcacgcacataacgtggtaaataccgtcaataatttcagtcccttcagtttcgtgttcaaatccagggaaatggtggtcccaggattgcagcgagcgtaaataacttacttgcggactgtttttatcgccgaagttttcaccagacagcagcatcgggattcctggcggatacgggataactgagtttgccgcgatgcgtcctggcagattttcaatggataccagttcgacattgttgtcgacaatcgcgttgtacgcttcacgcggggtgacttccgccaccggcaggccggaataggcttcgttcaaccgtgcgccagggttgttttctttcagccaggcaaacatggtgtcacccagatcgtgaatccccatgttcgcgtaagtgtcaggatattgttcaacaagttccggcatcacctgcgccagcggtgtgttggcgtcatagtggcgtttgaaggagcaaagggtgttaaccagagttccccatttcccacgggttacgcccatagagaacaggaacataatttggaagtcagtggtgcgggtaggtacaatgccgtggcgaccaagccaggcagtgaccagcgccgccggaacaccggtttcttccagttcaccatcttcacccattcccggagcaaggatgctgactttaatcgggtcgagcatactccagttatccggaatatctttgaagccgtgccagctttcgcccggatgcattacccagcagtcctgaacggtggtcagcagtttggttggtgcgtcagcaaagtcataggttttgccggtttgtgggtcggtgacgacttctttgttccacggtttgaagaaccagctaccgtcagcggtgaactctttatatagccgcgccatcgcctgacggaaatcaaccgcttcgtcaatcacttcctgtgtcagtgacaggccgctgttgccgtccatcatcgacaccgccacgtcgttggatgcgcagatggcatacagcggggaggtggtggcatgcatcatgtaggcctggttgaagcgggagaagttaatcgccccacgaccttcacgtacatgaatataagaagcctgtgacagcgcattcagcagtttgtgggtggagtgggtggcgaaaacggtaggaccgttgtgatcgccaggttcgccgcgcatggcatagtgatcggcatagatcgggttgaaacgtgcatagccgtaccaggcttcgtcaaagtgcagacgatcggaggttttttccagcagatcctgcgcttctttagcgttataacacacgccgtcataggtgcagttggtcaccacgcagtaagacggtttttgcccggctttgtctttggtcagcgggctttcactgattttcttctgcaaggtttcaggttgcatttcctgcggatagattggcccgataatgccgtagcggttgcggcttggcaccatatagaccggtttcgcgcctgtcagcatcaaaccttgttcgatggatttatggcagttacggtcaacgaccacgacatcgttatcggtcatgcaagcctgcatgatggtgcggttagagccggaagtaccgacgactaccgaccaggagcgatcggcaccaaatacgcgtgcggcatatttttcgctttcgccaaatgcgccagtatggtcaagcaaagaaccgagggaagttcgttcgatgcccatgtcggtgcggaacagattttcaccatagtagtcatggtagaaacgtccggcgggtgttttggtaaaaccaacgccgccctggtggcctggcgctgcccaggaatattcatggatgtcactatatttcatcagcgcgctgaacagtggcggcaacagctgctggcggtagcgggtcatcgcggcaacggcgcgtccggcgataaagtcggcggtatcttccagaatccaggcgaattcatcgacaagctccagcaggtcgcgatccattgcggcgagggctttttcccgatcgcccaacaggaagaccggcacgttttgttggcgctcatgaagcttaccgatcaattgtctgacgttttgatgttcgtccggatgttccatttgatagctgaacatcaggcagtcaatggcttcgtttgaagagagaatggcaaaaccatcatcaaaggaggtggatttaatcacggtaacattttgctggcttaaagcatctgccagacgctcaacggcgttaccgacccaggtgtcttgatggagaaactcgctttcaacaattaatactttcatcattgcttacccggttatgaaggaatcttcgttgcgggcaagtatcttccggccttttcgggctgtaaagcgcgtgaaaaacaaacatttttgaaatatttagttttataaacaatacgttatgtgattattttaaattattttcactgcttattatcgacggctaaactatttttttggctgatactgatatcgtctttagccgggaaacgtctggcggcgctgttggctaagtttgcggtattgttgcggcgacatgccgacatatttgccgaacgtgctgtaaaaacgactacttgaacgaaagcctgccgtcagggcaatatcgagaatacttttatcggtatcgctcagtaacgcgcgaacgtggttgatgcgcatcgcggtaatgtactgtttcatcgtcaattgcatgacccgctggaatatccccattgcatagttggcgttaagtttgacgtgctcagccacatcgttgatggtcagcgcctgatcatagttttcggcaataaagcccagcatctggctaacataaaattgcgcatggcgcgagacgctgtttttgtgtgtgcgcgaggttttattgaccagaatcggttcccagccagagaggctaaatcgcttgagcatcaggccaatttcatcaatggcgagctggcgaatttgctcgttcggactgtttaattcctgctgccagcggcgcacttcaaacgggctaagttgctgtgtggccagtgatttgatcaccatgccgtgagtgacgtggttaatcaggtctttatccagcggccaggagagaaacagatgcatcggcagattaaaaatcgccatgctctgacaggttccggtatctgttagttggtgcggtgtacaggcccagaacagcgtgatatgaccctgattgatattcactttttcattgttgatcaggtattccacatcgccatcgaaaggcacattcacttcgacctgaccatgccagtggctggtgggcatgatatgcggtgcgcgaaactcaatctccatccgctggtattccgaatacagcgacagcgggctgcgggtctgtttttcgtcgctgctgcacataaacgtatctgtattcatggatggctctctttcctggaatatcagaattatggcaggagtgagggaggatgactgcgagtgggagcacggttttcaccctcttcccagaggggcgaggggactctccgagtatcatgaggccgaaaactctgcttttcaggtaatttattcccataaactcagatttactgctgcttcacgcaggatctgagtttatgggaatgctcaacctggaagccggaggttttctgcagattcgcctgccatgatgaagttattcaagcaagccaggagatctgcatgatgtctgcacccaaaattacatttatcggcgctggttcgacgattttcgttaaaaatattcttggtgatgtgttccatcgcgaggcgctgaaaacggcgcatattgccctgatggacattgaccccacccgcctggaagagtcgcatattgtggtgcgtaagctgatggattcagcaggggccagcggcaaaatcacctgccacacccaacagaaagaagccttagaggatgccgattttgtcgtggtggcatttcagattggcggttatgaaccttgcacggtgactgatttcgaggtctgtaagcggcatggtctggaacaaaccattgccgatacgttggggccgggcggtattatgcgcgcgctacgtaccattccgcatctgtggcaaatttgcgaggacatgacggaagtctgccccgatgccaccatgctcaactatgttaacccaatggcgatgaatacctgggcgatgtatgcccgctatccgcatatcaaacaggtcgggctgtgccattcggtgcagggaacggcggaagagttggcgcgtgacctcaatatcgacccagctacgctgcgttaccgttgcgcaggtatcaaccatatggcgttttacctggagctggagcgcaaaaccgccgacggcagttatgtgaatctctacccggaactgctggcggcttatgaagcagggcaggcaccgaagccgaatattcatggcaatactcgctgccagaatattgtgcgctacgaaatgttcaaaaagctgggctatttcgtcacggaatcgtcagaacattttgctgagtacacaccgtggtttattaagccaggtcgtgaggatttgattgagcgttataaagtaccgctggatgagtacccgaaacgctgcgtcgagcagctggcgaactggcataaagagctggaggagtataaaaaagcctcccggattgatattaaaccgtcacgggaatatgccagcacaatcatgaacgctatctggactggcgagccgagtgtgatttacggcaacgtccgtaacgatggtttgattgataacctgccacaaggatgttgcgtggaagtagcctgtctggttgatgctaatggcattcagccgaccaaagtcggtacgctaccttcgcatctggccgccctgatgcaaaccaacatcaacgtacagacgctgctgaccgaagctattcttacggaaaatcgcgaccgtgtttaccacgccgcgatgatggacccgcatactgccgccgtgctgggcattgacgaaatatatgctcttgttgacgacctgattgccgcccacggcgactggctgccaggctggttgcaccgttaaaacgcgactaaacgctactgcgccgggggatttattccggcgcacacctctgacgataccaataacagaaggcgggcgttggtaacagcgacccgataccctatgagcatttcaatgactacaaaactcagttatggatttggagcgttcgggaaggattttgcgatcggcattgtgtatatgtacctcatgtattactacaccgatgtcgtcgggctgtctgtgggtttggtcggtactttgtttctggtggcgaggatctgggatgctattaacgatccgattatgggatggattgtaaatgctacgcgatcgcgatggggtaagttcaaaccctggatcctgatcggtacgttggcaaactctgtaatcttatttctcctctttagtgcgcatctgtttgaaggtactactcagattgtctttgtttgcgtgacctacatcctctggggcatgacttacaccattatggatattcccttctggtcgctggttccaaccatcacgctcgataaacgtgagcgcgaacaactggttccttatccgcgtttttttgccagtctggcaggctttgttacggcaggtgtgacgctaccatttgttaattatgtcggcggtggcgatcggggatttggctttcagatgttcactctggtactgatcgccttttttattgtttcaaccatcatcactctgcgcaatgtgcatgaagtcttttcgtcagacaatcaaccgtctgctgaaggaagccatctgacacttaaagccatcgttgcgctaatttataaaaacgatcagctttcatgcctcttgggtatggctcttgcttataatgtagccagcaacattattaccggctttgctatctattatttctcatatgttatcggtgatgcggatttgttcccctattatctgtcgtatgcgggagctgctaacctggtgacgttagtattcttcccacgcttagttaaatcattatcccgacgcattttatgggccggagcatctattcttccggtgttaagctgtggtgttctcctgttaatggcattaatgagctatcacaacgtcgtcctcattgtgattgcgggtattttgctgaatgtgggaacggcgcttttctgggtattacaggtcatcatggtggcagatatcgttgattacggtgaatataaactgcacgtacgctgtgaaagtatcgcttactccgtgcagactatggtggtgaagggcggttcagcctttgcggcttttttcattgcggttgtgttagggatgattggctatgtaccgaatgttgaacagtctacgcaagccctattaggtatgcagtttattatgattgctctaccaactctgtttttcatggtaacgctgattctctacttccgtttctatcgcctcaatggtgacacgctgcgcaggatccagatccatctgctggataaatatcgcaaagtaccgcccgagcctgttcatgctgatattccggtcggtgcagtgagtgatgtgaaagcctgacgtggacaatagctaacgaaaatggcctgatgcgatatgtttatcaggccacgtcttaatgtaatgctttggatttgcaaattttgtagaccggataaggaattcacgccgcatccggcatcaacaaagcgcaagttgttatccggttatcaagccaaagcgccgtagctggcggcaatgaaagcgagcgaggaatatcaccgtcgttaatgcgccaagcagcgcgcagaacatatcggattgcgtgtcccactggtcgccctgggtgccgagaaaatcatccgctccctgacccattgccagcgctgcccaccactcgattaattcatacatcgcgcttatcgccagcgccacgcagcagaccaggaacgccaccattttacgtccgcgcacgtacatcccgcgaacgagaatttctcgtgccaccagtgcaggcaccagcccctggaaaaagtgccccagcttgtcatacggattacgactcaaccccagccattcctgcacctcaaaaccaacggggactttcgcgtaggtgtattgtccgccgaccatcaggatgatggcgtgaaggaaaatgagcgtatagagcagcggcgttaacggataacgtctggcggtggcaagcagtagctgcacgacaataatcaccggtgtcacttccatcagccaggtgagtttgtcatgggccgaaatgccggtataaatcaggattaacgttagcgtcagtgcgctggtgttaagaattaacggcttgagtgtgcgggtcatggtgagttcgcaaatcagggaaaatactgactattcaccagcaagcgtgaaattacaatcgcaaaagaggtggccagggggatcacctggcagcatgctgccaggcgctgggccgaagaggttacttagtgcagttcgcgcactgtttgttgacgatttgctggaagaagtcgttacctttgtcatcgaccaggataaacgccgggaaatcttctacttcgattttccagatagcttccatacccagctccggataagcgacgcactccagatgcttgatgctctgctgcgccagtaccgccgccggaccgccgatgctaccgaggtagaagccgccgtgtttatgacacgcgtcggtaacctgctgactgcggttacctttcgccagcatgatcatgctgccgccgtgggattgcagcagatccacgtaggagtccatacggcctgcggtggttgggccaagtgaacctgatggataaccggcaggggttttcgccggacccgcgtagtagatcgggtgatctttgatgtactgcggaagttctttaccggcgtcaatcagctctttcagcttggcgtgtgcaatatctcggcccacgataatggtgccggtgagcgacaaacgagtggataccgggtattgcgaaagctgggcgaggatctctttcatcgggcggttaaggtcaactttcaccgcttcgccttcaccggcctggcgcagttcttgtggaatgtactggcctgggttgtgttccagtttttcgatccagataccttcgcggttgattttcgctttaatgttacggtcagcggagcaggagacgcccatgccgaccgggcaggatgcgccgtgacgtggcagacggataacgcgaatgtcgtgcgcgaagtatttaccgccaaactgcgcgccaagaccgagtttctgggcctcttccagcagttcctgttccagctggacatcgcggaacgcctgaccatgttcgttcccttccgtcggcagttcatcgtaatagtgagcgcttgctaacttgacggttttcaggttggtttccgcagacgtaccgccaatcacaaacgcgatatggtacggcgggcaggctgcagtaccgagggtacgcattttctcgacgaggaagtttttcagtttgccgggagtcagcagggctttggtttcctggtagagatacgttttgttggcagagccgccgcctttcgcaacgcaaaggaatttgtactcatcgccatctaccgcgtacaggtcgatttgcgcaggcaggttagtgccggtgttgacctctttgtacatgtccagcgccgcattctgtgaatagcgcaggttatcttcgatataggtgttatagacgcctttcgacagcgtttcttcatcaccgccgccggtccacacgcgctggccttttttaccgacgatgatcgcggtgccggtatcctggcaggtcggcagcacgcctttggcggcgatttcggagtttcttaagaattgcagcgccacgtacttgtcgttttcgctggcttctggatcgtgaagaatagccgcaacctgtttctggtgtgccgggcggagcataaaagaagcgtcgtgaaaggcttgctgcgccagcagggtcagggcttctggttccactttcaggatggtttcgccgtcgaagtcggcaacgctaacgtaatcggaagtgagtagatagtattcggtattgtctttccccatcgggaaaggtgcctggtagataaagggtttgtttgacatagcttccagcctgtaactctgtatttgttattcgaaaatggcgtgccgcgtagtcacgggcggcacgcaaagtgcatttataagaacccgtacatcgcggcgaagatccagccgaagacgcacgatacgctcacaccaatcaaccccggcagaataaagctgtggttgatgacgaagcgaccgatgtgggtggtgccggaacggtcaaactgaatcgctgccagatcgctcggataagtcggcaggatgtaataaccgtagcaagccggtgctgaagccacgatgtatgccggatcaacgccgatcgccagcgcgaccggaacaatcgccgccagcgccgcagcctgagagtttacaaacttggaaaccagcagcagaacaatggcataggcccacggatactctttcaccatttcacccagtacgccctgaatttcagacatatgcgcaccgaacatggtttctgccatccatgcgataccgtacaccgccacgatggcgatcataccggaacggaagacttcgttttttgagatagacgcgggattggttttggtcaggataataatcagcgccccggtcagcagcataaacatctgaataaccagtaccatcgacagcggtttgccgccgaaggatggacgcaggtccgaatcagcaccaagaagggcgactacagcgattgccccgaggaaaatccacattgccagccagttgcttttcggcagttttttatccagcagcgtcgcggtatcaccgtaaacatactcacggttttccggtacggagatgaatttctggaactcttcgtctttatccagatctttaccgcggaaccagctgaagataccgatcgccaggataccgattaacgtcgatggaatggtgattgccagcagatcgaggaactcaagatggcgaccatcaaaggtgacattacccagcatcgcaaccagagacacgaccgcaaccgacaccggactggcgataatccccatctgtgcaccgatagaacttgccgccatcggacgttccggacggatgttgttcttaatggcgacgtcgtagatgatcggcagaatggtgtaaaccacatgacccgtaccgcaaagaatggtcagtgtacaggtcacaaacggcgcgacaattgagacatatttcgggttgcggcgcagcagcttctcggcaatttgcagcatgacatcaagaccgcccgaagcttgcaaggtcgccgatgccgccaccaccgcaatgataaccagcatgacatcaactggtggtttacctggctgaaggtggaagacgaagaccagaatgaccagaccgataccgcctaataaacccagcgcgataccaccctttctggcaccataaaacagacatatcagtattatgataagttggatagtaaataacatgtgtgaaccctcgcgataatcctatttaaatttttgctgaatagatcacagtcacgttctgttttgtatgaactgttttcagagcctgactaaatatccgtttggtcgttaccggctttagcaaatacctcacagtgaatattggctgattaaagcagcggcaaatttatgcactgtgataagcggctttttcagagagaaagactctctggcgatgggtttatagtttgtactgcgcagatgttaatgttttgtttgctgttatcttattgatatttatcggtctattttttgttctcagggcagatgtcattaggtttatagattaatctgatctacccatttgtgggtaaaaatacacataatgcgggtgacataatagttaattaacttttgttagcgttttgaaattaaaaacaccgttcacctgaagagatattaatttttagcgatgatggagggataattatatttgatctggcacaagttttactgatgaaggatgtaacttgtgccaggggtattttgcattacggtaataattattacttacagataaccagcgatccgttattggcaatattgtttcagtagtgagtagtgttctgcctgaatacggtaacggtaaactggacgccccgtgacgccataatggatactggtgaacaagatgtggcagttgaccagccagatgaggtatttacggcaggaaacacgcgaaatgttaacctcgttggctagctcgtcggttgaaaattcatagtcctgatgcgcgtcaatccactggcacagtgtgcgtaacgtctgcggcgttaagccttttggcaagcgacgaggatcctgttcgttggagctgctgccgtggattagctgatcaagctcggcctggtcataatactgatgtttttccagcgccattttcttttgccgccagccggtgagcgcctcttcaaagcgggaagcctggaagggtttgatcaggtaatccacgacaccgtaatgcagcgaatctttaatggttgccgcatcggctgcggaggagatgacaatcacatcacttttgcaacgcgcgttatgcaggacaggcagtaaatcgagcccgttctctttttgcatatagatatcgagcaatatcaggtcgataggcgtatcgctattgaagataatctctttggctttctccagcgtcgaggctgttccacagcattgaaagcctgggatttgtgctacgtatcggcgattcagctccgcgaccattgcgtcgtcatcgataattaatacattgatcatctgttcgacctctccccgtcccagggtatctggacaaaaaattgtgtgaaaatcccgggttccgattccacggcgatgctgccgccgagattttctacctgttgtttgacaagtgctaaaccgacgcctcgctcgcttccttttgtcgagacacctttgtcaaaaatgtgatcgattttatcgggtgcgatccccggtccatcatcattaacttcacagtgcagccagccgtgacggtagtgcaatgttacgctaatttcgcctccgggttccggccctaatgcctccagcgcgttttctatcagatttcccaacgtggtaatcagcgtcgcgacctggtcctcactgccgctgtctggcagctggctttcactgtttaaaatcagcgtatggcctaaatcggtcgcgcggttaatcttgctgattaaaaaaccagcgataaccggagatttgatcttacccagcagagagccaatctcttcctgatagttattggctgttttgagaatgtaatcttccaactgcttataactcttcagatgcaataatccgagaatcacatgcaatttattcataaattcgtgggatcgttcacgaagtgcgtcagcatagttgaccagaccgtcgagtcgctgcatcagtttacgtacttcagttttgtccctgaaggttgaaatggcaccgatgataacgccattactgcgcaccggaacggtgttgatcagtaatagccggtctttaatcgtaatctcttcgtcgcggcgcggggtaccgtcgcgtaacacttccgagacatctaccacctgtgaccatgagtggcttagcgtcgacagtttctcatcgtcctgcgacttacggtaattcagcaattcttgtgcggcatcgttgatcagcgtgacctcgccgcgatcgtccacggcaacgacgccttctttgatagactgcaacatggcctggcgttgctcaaacagcgtggagatttcgtagggttccaggccgaaaaggatttttttcagtaccttaaccagaatgcaggtgccaatcagtccgaccagcatgccaaataataccgaccagataatgctccagcgactgtcattgatctgttgggtcacacggcttaactcaaggccgatcgccaccacgccaatttgtttatgattttcatcgtagatgggggtaaatacgcgtaaagcctgcgccagaaaaccgcgattgatagcgacattttcttcgccattcagcgctttaaggatgtcatcacctttaaatggctgaccaatacgctgggcttcaggatgcgagtagcgaagactttgcatatcggtaacgacaataaacagcagatcgttgcgtttgcgtacggcttccgcgatggcctggatgccactctcctgcggttttttctgcaagccctgacggatttccggcgagtcggcgagggtacgcgccactgccagtgccttgttggctagcccatctcgcgtcatatcactgatttgcgagaagtaaatcagatgcaccaccaatagcaccgagaacagtaccgcactgaccattaagatcactgtggtactcaatttcatcggacgtttgcgtaacatgcggtagggcaatgaatgtctcatcagcttccttgtgtgacaaatttcttaagcattatctctgatgaggcgggtaattcaaagggagtaagaatgattggctatataggggaagagactctggcaacggaaactgccagtgctgtatgaagattccggggctatgcttatagcgataatcatactgatgagagagggaaggtcatggatcaggcgctactggacgggggttatcgctgttataccggcgaaaagatcgatgtctatttcaacactgcgatatgtcagcattctggcaattgcgtacgtggcaacggcaagttatttaatctcaaacgaaagccgtggatcatgccggatgaagtcgacgtcgccactgtggttaaagtgattgatacgtgcccgagcggcgcgctgaaataccgtcataaataagcgagggtaaaatggaaatacgcgaaggccacaataaattttacattaatgacaaacaaggcaagcaaatcgctgaaattgtctttgtgccgaccggagagaatttagcgattatcgaacataccgatgtcgatgaaagcctgaaagggcaagggattggtaaacagctggttgcgaaagtcgtggaaaaaatgcgtcgggaaaaacgaaaaattatcccattatgcccatttgcgaaacatgaatttgataaaacgcgggagtatgatgatattcgcagttgatgggagagtacagagtcacgatatttttcattctctccgcgatgtgatgcaggagagcatctgaagggtagggggatgcacaaagaatgggcagagagcgcgtttttttgtcccaagtcatcccctttactgagcaaaaaaaagaatatctcctatatgagaatcatcaatcggggttaataagttttgcgtccccagagcgtttaatattgataggagtcatattatggaaggtaaaaacaagttcaatacttatgttgtttcttttgattatccatcatcttattcctcagtgttcttaagattaagatcattgatgtatgatatgaatttctcctctatcgtggctgatgaatatgggataccacgacaattgaatgaaaactccttcgcaataacgacatcgttagccgcaagtgaaatcgaagatttaatcaggctcaaatgcttagacttaccggatattgattttgacctcaacattatgacagttgatgactatttccgtcagttttacaagtagccaggaaggataagaagaacataaaaaatggcactattctctaaaatattaattttttatgtgattggtgtgaacatatcctttgtcattatctggtttatctcacatgagaaaacacatattcgtttacttagtgcattcctggtcggaataacctggccaatgagtctgcctgtggcattacttttttctctcttttaggagctgtagttgagtggacccgctggttatcgtgaaacgaagcgtctctcctcaaaactggatttgcggaacgatgaacgaagcagtcgcctgactgcttcgttcattaaagtgaaatttatttctgtgggcgcatcgccgggaagagaataacgtcgcgaatagtatggctgttagtaaacagcataatcattcggtcgataccaatacccagaccagcggttggcggcagaccatattccagcgcagtcacgtaatcttcgtcatagaacatggcttcgtcgtcacctgcagctttagcattaacctgttcctggaaacgttcagcctgatcttctgcgtcgtttaattcgctaaaaccattaccgatttcacgaccaccgatgaagaattcaaaacggtcggtgatttccgggttaacatcattacggcgtgccagcggggacacttctgccggatattccgtaataaaggttggctgaatcagatgtgcttctgccacttcatcaaagatctctgtgacaatacgtcccaacccccagcttttctctaccgtaataccgatagattcagctaatgctttagcagcatcaaaattatccaggtcggccatatcggtttctggacgatattttttgattgcttcgcgcatggtgagtttttcaaacggtttgccgaaatcaaacacatgctcgccataagtgactttagtggtacccagaacctcttgtgccagggtgcggaacagtgactctgtcagttcaatcaaatcgtggtaatccgcatacgccatgtagagttccatcattgtgaactcaggattatggcgaacagaaataccttcattacggaagttacggttgatttcgaatacccgttcaaaaccgcctacaaccagacgtttcagatacagctccggcgcgatacgcagatacatatctaaatccagagcattatgatgggtaataaacgggcgagcagatgccccacctggaattacctgcatcatcggggtttctacttccataaagccgcgcgcgaccatgaattgacggatagcggccagaatttttgaacggacaacaaacgtttgacgggatttatcgttagcgatgaggtccagataacgttgacgataacggacttcctgatcctgcagaccatggaatttatctggtaaaggacgtagtgctttagtcagcaggcgcagctcagtacagtgaatggaaagctcacccgtttgcgtcttaaacagcgtaccgcgggcaccgataatgtcacccagatcccattttttaaactgatcgttataaacaccttctggcaggctatctcttgcaacgtacagttgaatacggccaccgacatcctgcaacgttacaaaggaggctttccccatgatacgacgggtcatcattcggccagcaaccgagacttcaatgtttaaggattccagttcctggttatccttcgcatcaaactcttcgtgcaactggtcagaggtatggtcgcggcgaaaatcattgggaaacgccacaccttgctgacgtagtgccgccagtttttcgcggcgatttctcagttcatcgttaaaatcaatagcctcattggctccccgtgtttcttgttcagacattttggttcctctaaatccagctttcaatttagcgtagataaagagacagatcggtacactgtattatctgcctcgactattagtaactcagtttatcttatcgaaactaacgcttacctcaagttgatatcactaataaataaccatcaaaatggtttaaatgacttattaatctcgatttgttagtgttataaactgaaagttaatttattcataaccaattgtttttacgacagttaatcgttgctctcctgtatcatattcgtcggcgtgctaaacagaaaacgggtagcaaaggccaatacgacgatgatcgcgacacaagccaacgtccactctcccatctgagaaaagaatcgctggtaagctgcaattgccataccgctaatttgcgactctgtcgtctgctgtgccacgacgcctgccagccagttggcgaccgcgcctgttgccagcatataaatcccggttaatacgccagacattttcagacgcgtgatttgcgcaatcgccaccgggtcaataaagagttcggcaaagcccattagcgccagcccggatatcatcacgcccattgacgcttgaccgtcagccgctgcatgtcgggcatcaaatgccaacaacataaagccacaagccatcagcagtaagccaaaggcaaacttcagccagacgcgcaatgttgagttgccgcggctttctggcgacgccagccaggccagtacaaccccagcgagcatcaccgcaattgcattcaccgactggaatagtgctgtaggtacttcaatattgaatgcctgacgattcacaaagcgatcgataaacaagctgatggtactgccgccctgttgtgccagtacccagaacaatgtcccgacaaacatcaacaatacaatttgccaaagagcacggcgatgttcggggaatttgatcatcatgcgggcaatgatttgtgcggcaatgaggcaaacgatcgccagcaaatatccggaccagtcgttctccagcagcagagtaaaaaatactggggctaaacagagcatcaccactaaccagctccatactggtaaggcaaatttgacactagtgagcgcttttttatccatactacgtgtggactggaaatgacgatgaccgcttaagaaaatcaacaaaccgataaacatgccgccacccgcaagggcaaagccaacatgccatccataccactgagcagccaggccgcaggcgattggggctgcgatagaaccgatattgcccgcagcatacagcagcgaaaaaccgccatcacgtcgatgatcgttctcgtcgtagagctcgccaagcaaacagctgatgtttgatttgaataaaccgtagccacaaataatgattgccagcgccagatacaggctaaaggttgaatttgtatcaatacccagcaccacatggccaagggtcattaacagcgcgccggcaatcactgcagtgcggttgccgagcaggcggtcggcaagccagccgccgagaataggggtaacgtaaaccagagaagcatatgcgctgaacaggctgatggcatggttatcatcaaaaccaagctgatgggtgagatagagaatgagtaaggcacgcatgccgtaaaaactgaagtactcccagatttggatcgccacgatatagtatatcgcgcgcggctgtgagggtgttttcatgtgttctccttatgagcaaaaaagggaagtggcaagccacttcccttgtacgagctaattattttttgctttcttctttcaataccttaacggtatagcggccatcagcctgacggtatgcaccgtgaatatcggtttcaaagcccggatagtgagcgccgatttcacacagcatctgcaggaactccagaaccggacggctttcttcggtgatcatttcacccggcattaccagaggaactcccggcgggtacggaaggatcatattggcgttaatacgacctaccatttcgtcgaggtaaacttcttcggtcataccgtgcagctctttctggaatgcagcatacggagtcattaccatcgtcggcagcacttcaaatgcgcgatacatcagatccggcagattgtggtgaacaatcagtttgtggatattctgagccagttcctgaatacgcatgttttcatagaattcaggatcttcacgatacagagacggcagcatgtttttcacacgcaggttcaggtcgaacgcacgtttaaagtcagtcagagcacgcagcaggctcagtgctttggtcttatcgataccgatgctgaacaggaacagcaggttatacggaccggttttctcaacaacgatgccatgttcgtcgaggtatttcgccacgatgctggccggaataccaaagtcgctcatggtgccgtctttttccatccccggagtcagcagggtgactttgatcgggtcaagatacatgtgctcgttatcgatgtttttgaagccgtgccaggtgctgtcagaacgcagcggccagcattcagtcgtatcgatatgatccggctgccatacatcaaagaaccagccatcagattccgttctcagacgtttgatctctttacggaatttgatcgcacgttcaatagaaccgttgatcagacgcttacctgcattgcctttcatcatcgccgcagcggtttcagtggacgccacgataccgtagtgcggagaagtggtggtgtgcatcatgtaggcttcgttaaaggtttcttcgtttacgtcacctttaacgtggatcatggaagcctgagagaacgccgccagcagtttgtgagtggactgggtttcgtaaatcactttcccttctacacggccaccgctcataccgcatttaccttcgtaaatcggtgagaagttggtgtaaggcacccacgcggagtcaaagtggatggatttcacatccagtgttttcttgatgaagtcggtgttgtacagcagaccatcataggtagagttggtaattacagcatgtaccggccaggttgcgtttggtgtttctttcacgcgcttagcaatggtagcgtgctggaattcactctgtgggataccaccaagaataccgtaagcgttacgggtcgggcggaaatagattggcgtaacatcgctcatcatcatcaggtgggtcagcgatttgtggcagttacggtcaatcagaatggtgctgcctgctggagcagagtacataccaacaattttgttcgcagtggaagtaccgttggtcaccatgtagctgcggtctgcgttaaagacgcgagcgatatactgttctgcttctttgtgtggaccactgtgatccagcagagaacccagttcagatactgaaatggaaatatcagatttcatggtattcggaccaaagaaatcatagaacaggctacctaccgggcttttctggaatgcagtaccgcccatgtgaccaggagtacagaaagtatatttaccttcacgaacatatttaaacagtgctttagtcagcggaggcagaatagtgttgatatattcgtcagtggtctgcttgatcttattagcaatatcttcagcagcacccagcgcatattcaaagaagctaatctgtaaacgcaggtcattcaggcttacatcgagagtggaatacgtattagcgaacgcgtacaacggcaggttctcgttcattttgctaatttcttcgcacagctcgagattatatttatcccagtcaaaaataacgccgcacagacgcgcattgttttcgatcagttttaataagtcgtcacggtcgttcgggtaaacaatctggaagttcagacgttcaagcgcgcgatgaagttcacggatgggttcttctttaaaataaacccccatgtgattcaatattgcaataacgttcatagtcatatctccaggtaaaaaaggcccctcccaacacatgggacaaaatgaaaggaggagcctcggaaaatacttttaattaatgtgcgttagacgcggtgtggttatccattgagtggctctggcgctcgtgcattttgcgagcgtagaacatcaggataatcaggctgacgatgaaggtacctgccagctcgaaggagcttgcgcccatcagcgcgatgaagcagaacacgcaacccagtacagagcagatcaggctgacaaagttgcggatgttaacgccttcaaaacgaatcaggtcaacgcaagagtagaaatacggcagcatagtcagcagtactgcgataccggtcagttcaccgaacaggtcagatgctttaccaccggcagagttcatcagagtgataaggatcatcagggcagtcattttcactgcagccagcagcagaccttttttcggaataccgttgctgtcgacttcaccataaactttcgggaagttaccgtcgttagcggcacgtacacctgcctggcctaccaacatcatccaggagcccagagaagtcaggcacgcaaaggcggtgaatgcagaaaccagcggcgcagcccagttaccgaggatagttgaagcactgattgcaaacggagcaccggaagccgccattacagaagacggatacataccggaaagcacctgagtcgcagcgatgtaaacaatacctgctaaaccagtacccagcatggttgccagcggaacggtacgtttcgggtttttaaccataccagtacttacagctgcggattcaacacccacgaaggcccacaggcagagcagaatacttttaatgatcgcatgaccatcagtggtatccgcagtattccagttagctgcataagttgccgcatcaaaccaatgccagccaacaatagcagtcatcaccacaggaataagaaccagcaccagaccaatagtggttaaacggcttacccaagtaccgccgagcatatttacaaaggtaaatacccagacgatagcaatacaggcgatacccgccggaacaggatcatttaatactgggaagaaggtggaaagataagatacagcggtaataccaatcgccaggttaccaatccagttagcatggtaataaagaacacctgtctgaaaaccaaatgcaggggaaatttctccggcataagcaattgggccaccttgttgcgggttttttgttgccagtcgggcatatacatacgccagcgacattgcaccaataatagagataatccaaccccagatagcaataccaccgatacttgctaggttcgcaggtaataatgcaataccgctccccatcatattaccggcaacaacaccggtacaggcaaatagcccgatcttcttggcagaactcatgctcttctcctaatttcatttttgaatttggagtccgggtcatgatgtataactatttcctgaccagaccaaactggcgataagattactcacgaaaaaaggattaatcctaaagattaggtgaaataacacaaaagtttctgtaagtgagaacttgaggttttttattaacacatcaggatcgcaagttgatatcatgaaaagataaacatttaatgtttacaatggattgcgtgacattctctggttaaatttatgtaataaaaattatgcggcaaataaattgccgcaacatattataccaacaggaacatacaaaaactcaacaacaaatatttccgagcataaatcaacccggagttacttattctgaagcaagaaatttgtcgagataaggtacaacataaggaacagaagtctggaatataccattttcaatccagtaaagggtgtttgcccctgggcgtaaattaaaggcggtgagatatgcatcagctgcttcccggttcatccccttcatttcataaaccttgccaagcaacacataatttagccaggacatttcaagatcaatgccagtatttatcgcctggtaagactcatctgttttaccttttaccagagcactgaccgcttttatttgatatataatggacaggttgttcaattccggcagtgtaacaatgttatctatttctgtgttcagtgctgctaattgtttttcatctaaaggatgttgagaatggcgcacgatatcaactaatgctttttctgctctcgcgtaggtaaattctggggatgattgaacaatctcacctaataattcactggcacggttcaatgatttatcatcgccatgcagtaaataatcatgtgcctgataaaaattagttaataacgcaccacgatgcggcaaaattttctggagcgtctcctgcattcgttgtggccacggttggtttaacgcttttgataaactctccagtaaatcattttgaatcgccagctgattaccgttagtgatgacataacgtttatccagcatggttgaaccatctgcattgtctaccaattttatcgacataaagcattgttgagcacggtattggcgctgattaacaaacgcaatagataatgttttaccggaactgctcggttcatcaatgttgtagttgattttgtcatgcaccataaaggtggagaaggtgttaagtgatgtcgccaccaaatcacccacgcctatcgcgtaagagagctgatacggggaactccagctgttacaacttttatttaccatattaatgtcaatatcgcgtggattgagcaaaatacgcgatttgctcataggaagacgtgtatcaagacttgaaaacgctaccagtgctacacagatacctaacgacaacaggaaaaaaaaccatacccaaaaggtagtgaatcgtttgcttttaactggggattgttcaggtggcgttgcggtgttttgaatgttaagactgtgggagggagaatctgtggcaggaaccgcctctggtatagggggaggcgaagatagcattatttcctctccctcttcttcgctgtaccagataaccggcaccattaatttatagccgcgctttggtacagtagcgatatagacaggactatcttcatcattatcttttaatgacttacgtagttctgagatactctgcgtcacaacgtgattggtgacaatacttctcttccagacattatcgataagttcatccctgctaagtacttcgccactgtgttgagcaaagaaaaccagaagatcgattaatctcggctcaagggtaagttgacgcccattgcggctaatttggtttatggacggagtaacaagccattcgccaacgcgaactacaggttgttgcataatagaaactcattcgaaaagggaatgatgcaatgataattgccacaacctatttttaccatctatagatgggtttatttacatattattggtgaatgcaagacgttatttttaccagccataaacttcttgattacatagtattacgaaaggattttactgagaaccagaagtaatattccttaccatcaaaattcatcatctttgccaaagaaaaatgttcagaaaataatccatggaaaattgtccggagcacttactattttaatggattgttagtctttgcatgagcaagcgaactgatacatttctctttgttctcattcagaaaatctcatcagtcgccgttcagaccggtgttgtgctttatggatgcgttacgctcctgatgacgtcatttgacgttcaacagcatcacggggccgcacgacatttcacgtcagttagtgctatagctcaggaacaaattttcccgaattgggatatgcccgcaaattgctggtgatgtggggagaatctggttgagttcggtagaattgatttggaggcagaacgcttaaatcgtggcgtcctgaaacgaaaaacggacctccgtggaggtccgtttatatgaatttggtgcccggactcggaatcgaaccaaggacacggggattttcaatcccctgctctaccgactgagctatccgggcaacggggcgcattaaaccgtaatctgcacatctcgtcaacctaatttcagtaaaagcgattcaactgcttaagattgcggcaaatcgcttcttttctgtgtttctgtcaggtcaatgcaccaccctggcggcagcgggcgaagcgcaggatatcttccgccagccgatgtgcagtgtcgacatccgcctggctacgattcaccagcattcggcttaaacagccttccagcaccagttccatctgctttgctaccatcgccggatcgtcaacttccagtgtggttaacagttcgtgggtgaaatcgtaggccgcgcttttttgctgatcggccagttgatgaatagggtggccaggatcgggataaaacgtacaggcagcgataaatagacagcccggatagcggttgtttttaacgcactccgataacgcctgataacgtgccagcagcttttgttcggcggtttgcgtttcgtccagcatcagctgacgacgccagacatctatctgttggctaagataacgcagcgcatcgtagaggattgcctctttgtctggccagaagcggcgtagctcgtccagtggataatccacacgttcagcaaccatctccagcgtggtgttggcaatcccttgtaattctaataatttcagggcttctcccagtacatcttcacgttgcacgctattttcctccgtctttcccactgcaagtgtcgttcacggttggcgatcgcgcaaatgtgcgctgaaggtttcagcatccataaagcccgtgacgcgtgcttgtggatgctcctggccttgtccgtcaaaaaagagaattgtcggtaggccaaggacattaagatgctttaacagcgccacatcttgtgcgtcgttggccgtgacgttggcctgaagtaagaccgtgtctgctaacgctttttgcacctgcgggtcgctgaaggtgtatttctcaaactctttacaggcgacgcaccagtcggcataaagatctaacatcaccggtttgcctttggcttcaacgagcgcctgatttaactcatctaccgttttgatttgtgtaaagttgagatgcgtctgagtttgcgcggtatgcgtcgcaccaaatgcccaatcctgaagtgggcgcacgctaaccaatgccgctgccagcagaataatttgcacaatacgcatccagccgcgtttagcctgtaggctggtgataaaggcccagccaaagaatgcgacacccagcgccgaccacaagcgtaatccccatacatcaccaatcactcgctccagcaggaagaccggcagtgcgaggatcacaaaaccaaacgcggttttgacttgttccatccacgggccgcttttcggcagcaagcggttaccaaagacggtaattagcatcagcggcaggcccatgcccaacgcatagagataaagcgtgccgccgcccagccacatgttcccgctttgggcgatatacagcagaatcgcgctaagcggtgcggtggtgcatggtgaacagatcagtccggcaatcgcccccataacaaacacaccgccaggtgagccgccctgttggcgattgctcatcaacgtgagacgtgtttgcagcgaagaggggagttgcagggtaaacaagccaaacattgacatcgccagcaaggtaaagacgatggcgaggccaatgagcacgtatgggtgctgtagcgccgcctggaactgtaaccctgcggcggcaaccaccagacccagcgccgtgtaggtcagcgccatcccctgcacataaataaaggtcagcaacaatgctctggcagtggagagccgctgtttaccacccagcacgatgccagaaatcagtgggtacattggcagcacgcatggcgtaaaggcgataccaataccgatcaacaacgcccagagcgcggaaaagggcaattgcgcggtgggctgctcttgctgcggaacagacacaggctgtggcgctgcgttgttggcgaccacttcgcttaacggaacggttttggtttctggcggataacagaaaccggcatcagcacagccctggtaggtgacagttaacgtcgctcccgcactcgcctggttgatggtgacgggaagcgtcagccgatcgcggtaaatctcgcttttgccgtaaaactcatcttcatgccagacgccttgcggcagctgcacgtcggcaattttcgcgtgttccggcgtaatgcggatctgtttacggtagaggtagtaaccgtctttgatctgccaggtcagattaaggtcatgttggttttgctgaaaatcaaaagcaaaggcttgatccgcggggacaaattgtgaacgtcccggcgcgtcgaataatccggcaaaaacggaagtgctgcaaagtagcaggatcagcgtaaagatgcgttgagccatgagaggtaatctgtgtctccgtgtgtaacaggtaaaaccagaagttccggggtttgatatggatgatgagacttcaggcattccagcagtgcctgctggtgagatacggtagtttttaaaatcatctgcacttcgtattcttgctccagcttaccttcccagtaatagagagaggtagcgccggggatcaaggtcgcgcaggccgccagtttttccgccagcactttggcggctaaatcctgggctgtcgcttcatctggtgccgtacatagcaccacgacagacgcggtattcgaacttttttcatcaagcataaacacctcgcaagaacagatggaaccgcaagagagaggtcactatacaacggacgggggaaggatgttagtcggcgggaaagaaagcggggcgtgaacgccccgcgattgatcattacagcatgaagctacccagcacgaagccgaagcaaacggccagggcaacacccagagtacccgggatgaagaacggatggttgaagacgaatttaccgatacgggtagtacccgtgtcatccatctgtaccgcagcaaccagcgtcgggtaggtcggcagaatgaacagaccagacaccgcagcgaaagaagcaacagcggtcagcggtgaaacgttcagtgccagagccatcggcatcagtgcttttgcggttgcagcctgagagtacagcagagcagaagcaaagaagaagatgacggccagcagccacggatgaccctgaatcacttcaccagcggtatctttgatccagtcgatgttgttggaaacgaaagtatcgcccagccacgcaacacccaggatacaaatacaggcgctcatacctgctttgaaggtgctggagttgaggatgttgtcggtatcgactttacagataacggtggtcagagttgcaacgctgagcatgatgatcaggattgcgttggtggtgttcatcagcggtttttcaaccagacccatgcttgggctgttgatgattgcatagataaccacgccaactacgcccagcaggaacagccagacggacgtttttgcaccggatttgatttcaatctgcttttcaccgcgcagttcaaccaggccctcttccagacgcttgcgataaatcggatcgtcagagagtttggagttgaacagcatagtgaccaggaaggacatcaccagaaccgccagcagggtggacgggatgaccacggagagcagatggaggtagctgatgccatgaccttccatcacggaagacatgtaaaccactgccgctgagattggcgatgcggtgatcgcaatctgcgcggataccactgcagtagacagcggacggcaaggtttaacgccttgttccttcgcaacttcagcgataactggcagtgtcgccagagagatgttgccagtaccagcaaagatagtcaggaaataggtcacgatcggtgcgaggatcgtgatgtatttcgggttacggcgcagcagcttttctgtctgatgaaccagatagtccagaccgccagcaacctgcatggcagaaatagcggcgataaccgccatgataatggagatgacatcgaacgggatgttaccgggtttaacgccaatagcggcaagaaccagcacccccaatccgcctgcaaaaccaatacctattccccccaatctggcgcccaagaagatcgccagcaaaactatgatgagttctacaactagcatattagccttccttgttttttaacaagttgatattagattgttatttttaagttactgctcacaagaaaaaaggcacgtcatctgacgtgccttttttatttgtactaccctgtacgattactgttcgctttcatcagtatagcgttttgctttgtaagccgggtgcatcagattctgtacggagaaaatatcgtcaagttccgcttcagtcaacagaccgcgttccagaacgacttcacgtacactcttaccggtttcggcacagattttacccacgatgtcaccgttgtggtgaccgatgaacgggttcaggtaagtaacgataccgatagagttgtaaacgtaaccttcgcacacttctttgttagcagtgatgccgttaatgcatttttccagcaggttgtagcaagcgttggtcagaatgtgaacggattcgaacatggcctggccaatgaccggctccataacgttcaactgcagctgacctgcttctgctgccatggtaacagtggtgtcgttaccgatgactttgaagcatacctggttaaccacttccggaacaaccgggtttactttagctggcatgatggaagagcccgcctgcagttccggcaggttgatctcgttcaggccggcacgtgggcctgaagagagcaagcgcaggtcgttacagattttggacatcttcacagccaggcgtttcagcgcgccgtgaaccataacataagcgccgcagtcagaggtcgcttcgatcaggtcttcagccggtacgcatgggaagccagtaacttcagccagttttttcactgccagcggagagtactctttcggcgtgttcagaccagtaccgattgctgttgcaccaaggttaacttccagcagcagttcagcggtacgttggatgtttttcacttcttctttcagcaggatgctgaaagcgcggaattcctgaccgagggtcatcggtactgcgtcctgcagctgggtacgacccattttcaggatgtcctggaattcgacagctttacgttcaaagccttcacgcagttggttaatcgcatctaccagcttaatcagggaagagtaaactgcgatacggaaaccggtcgggtaggcgtcgttagtggactgacatttgttaacatggtcgttcgggttcaggtactgatattcacctttttggtgacccatcagttccagaccgatattggccagcacttcgttggtgttcatgtttacggaagtacctgcgccgccctggtagacgtctaccgggaactgatccatgcattttccgttgttcaggacttcatcacatgcggcaatgatggcattcgctacacttttaggaatggtttgcagctctttgtttgccatagctgcggcttttttaaccattaccataccgcgaacaaattcaggaatatcactgattttgttgttgctgatatagaagttttcaatcgctctcagagtgtgaacaccatagtaggcatcagctggaacttccctggtacccaacagatcttcttcgatacgaatgttgtttgacatgtgaaccttctttttcaagctgccaatgatttgctttaaacacacagaatatatgtggtttcgaatgtttttcgaccgacgattatcccctgcatcgaccgaatacccgagatcatatgctgcttgaggatttctaccgtaatctggatcactttaagtgtcggtttttaccccttaattattaatttgtgaaatagatcaccgctttgggattactaccaaaaatagttgcgcaaacatcttgaaattttgctaatgaccacaatataagctaaacgcgattcgcaacccattcaggtagccggggttaaccggctgctattacaggagaaacctttgcgctggttaccttttattgccattttcctttatgtctatattgagatttcaatctttattcaggttgcccatgtattgggggtattgctgaccctcgtgctggttatattcacgtcagttatcggtatgtcactggtacgtaaccagggctttaagaatttcgtgctgatgcagcaaaaaatggcggcgggtgaaaacccagcggcggagatgattaaaagtgtttcgctgatcattgctggtttgctgcttttattaccgggcttttttaccgacttcctcggtcttctacttttattgccgccggtgcaaaagcatctgacagtgaagttgatgccgcatttgcgcttttctcgcatgcctggcggcggttttagcgccgggaccggtggcggtaatacttttgatggtgagtaccagcgaaaggatgatgagcgcgaccgccttgatcataaagacgatcgccaggattaatgtcgaaacgccggattatgtggttatgccattttccggcgtttttcgttttggcagcaacagccataaccccgccagcatgatcagcgcatagagacttttccagccgaccattgccagtaacagaacgcataacagcccgccaaccaccgccagtagtcgataacgtccttgcaataatttacagcctgccagcatgcataacagataaatcataataaagatgccattggcataaataataagagcgtccagattgatctctaaagcatgaatcaccaaagtgctcaccacacagcagccgagcaccgcattgagggcattattcgggatatggcgagaagagaggcgtgccaggtagtggtcaggattatgttgcgcctgcgaccagaccaggcgggcgaagctctgtatataaatgttgagactggcaaagcaggccagatagccaatcacgcaggcaatccataacgctcctacaccgaacaactgcactacaatttttggaagcgatgctgccgccgccattttttcaccataggcgtcgaagtgtaagacgactaccgtacagccccagtagactaatcctgccagcagcagaccaatcatcaaagcacgaggaaaatcacgctctggatttttaaattccgaggcgagatgggcaaatgcctccagaccgacaaaacaccagaacatcactgataacgcagcaaataacccggtaagttcgatattaccaggtgccggaaaggggatattcgcaggtttgatatcgcccgcccaccagatagcgacaatcagcgcgacgataagtccggcaataacggtttgtagattagcactggaactggcaccgcgagtaccgatataccacaccagcgccagcgtaccgagttctgccaacaacagttgccagctatgccagccaaacatcgcctggccgaacccggcggcaatttgtagtgcggcaggcaaacccacgggaatgaccgataaaaacagccagccggtgactcgctcaagccgcgaaccaaacgccataccgacgaagtgcgcgacgccgcctgcgctgggatagtggcgacccagaatcgcaaacacaatcgcaatcgggaacactaagataatcaaaacgggccacgcccacaggctgttattgcccgctaccagcgcagctaacgcaggaacggcaaacacgccagtgcctaataatgacgtcgatagcaggccaatgccctgggccagccccagttcttgtttgagtccactcatgggttgatgtccgattgcgcccaaattttgggcaactgcgtagattttcgatggtagcacaatcagattcgcttatgacggcgatgaagaaattgcgatgaaatgtgaggtgaatcagggttttcacccgattttgtgctgatcagaattttttttctttttcccccttgaaggggcgaagcctcatccccatttctctggtcaccagccgggaaaccacgtaagctccggcgtcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggctatcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaattgccctgcacctcgcagaaataaacaaacccccgggcagaaatgtctgggggtttttcttttggtcatctttctagtataagattcagacacggacgacgcgagtggcgtccagctcattgattatggggaataacatgcacgtaaaatacttagcagggattgtcggtgccgcgctactgatggcgggttgtagctccagcaacgaattgagtgctgccggtcagagtgtacgcattgtggacgagcagccaggcgcagagtgccagctgattggtactgcgacaggtaagcaaagcaactggctttccgggcaacacggagaagaaggcggttctatgcgcggcgcagcaaacgatctgcgcaaccaggcggctgcaatgggcggtaacgtgatttatggcatcagtagcccgtcgcagggaatgttgtccagttttgtcccgacggatagccagattatcggtcaggtttataagtgcccgaactgatgtgatccagaggctgggtgacaaacgtataattgcctgatgcgcttcgcttatcaggcctacataaggcattgcaactgattgaatgcttgagaatttgtaggccggataaggcgtttacgccgcatccggcatgaccaacgatcacgttatcagtcatttcaggctggatggctccagcctcgcattagcaaagatgagattatttcgcctgtggtgcagttttgctggtggattgaacacgtaagtgatgcagcgcgcgtaagcattgatcctgggttagcggttgggcgttattcgccgctacggtgcgaacatagacctgacatggcacacccgcgagttttttcagtcgtgggctgaaatcaagcattcggcgagtgatcgcttctatttctttacccggcgttgcttcacgcgttttcaccactgcgccgctaaattgttctttgccactttcatctttaaagcggtaaagcaccgccagataatggtcgaacaagttatgtttccattccggttgggaataggtgtcatattccagattgccattgtcctggcagtcaacgtcgtataacggcaggaaatctaacagtgaggtaatacgtaatgccagttcacgcatttccgcattattaattgcatgaatgattgctcgcgccagcatttcaatctgcaactcattgacgactaactcacatttgctaccgtcatgtagcgttaatacgaaggtaagattttcgccttgattatcggtaagttccagcgtgttaacccgacgattaatatcggcatttttaagctcatcaaccagaatttctgggatgttttctgccattttcttaatgactttatcgcgagcttgctcatactgaaggtgtgcagcagcatccagtttatgcttttgatgcagacgactttccagcgcaatcagcaggtcgcgcagttccatgacagacataaagaacaacgattctttattgcgaggttctttaattttcagcgccagtgcaatgaaattattactcttgcgaataacaccggtattaacacccttgatgcttatggccatgtaggttctccctaaccatttctcaattaaataattaattttaatttataagccagataaatgggcttggtagtaatagttgttaaaataacataaatagccgtactcactctatataaacagaaaagaaaggttaattattggtgttagctatataaaaagtaacaacagcaatgcatatgaataattaaaggttatgcaacgggcaaagattaaacttcccagtttaatgacaggttgctgtacttgcgtttgttgctcttgccggatgcagcgtaaacgccttatccggcctacagttcattgcaaatccattcaatttcaatgcacgatgtaggcctgataagcgtagcgaatcaggcaattttaatgtttaacttccctgtttaatcagttactgctggcgtagctggagatccagcggcgttttgctgggttcgccgccaatttctcgcgccagtttcggcaccagatatcccgacaccagtgtcagcaactcacgcataatctgccgtgcttcgtcatcactcaccataaaatgcgccgcgccctgtactttatcgagcacatgcaggtaatacggcattacgccggcatcgaacaacgcattactcaggtttgccagcgtttgtgcgttatcgttcacatcacgtaacagaacgctctggttcagcaaagtaacgcctacccggcgcaacttagccatcgcctgacggaatgtttcatctacctcattggcatggttgatgtgattcaccagcaagatttgcagcgtagaacgggcaaagcattcaaccagcgcctcggtgatacgtgccgggatcacaatcggcagacggctgtgaatccgcagacgttttatatgcgggatggcttccagttgtgtgagcaaccagtccagctcgtgatctttcgccatcagcggatcgccgccggagaaaatcatctcgtccagttccggatgcgcagcaacatactcaagtgcagtttgccagttacgcttgttgccctgattttcggcataggggaagtgacgacggaagcaatagcggcaatttaccgcgcagccgcctttgaccagcaaaagcgcccggttgtggtatttatgcaacaaaccaggcactacgctgtgctgttcttccagtgggtcggtggagaatccgggcgcgatgacaaactcatcttgcgaggtaagtacctgacgcaaaagaggatcgtccggattgcctttctccatgcgatcgataaatgagcggggcacacgcagggcaaaaagctttttggcgctgcgtccggctaacagtttttcctccgcgtctatattcaaaagacgcagaagttcatcaggatcggtcacaacatcggcaagttgcgttaaccaatcttctctggatggggtatttagggttacaatatgcgccattttgtggcttagctaccaattaacaaatttcagagggccttatggcaacgtactatagcaacgattttcgtgctggtcttaaaatcatgttagacggcgaaccttacgcggttgaagcgagtgaattcgtaaaaccgggtaaaggccaggcatttgctcgcgttaaactgcgtcgtctgctgaccggtactcgcgtagaaaaaaccttcaaatctactgattccgctgaaggcgctgatgttgtcgatatgaacctgacttacctgtacaacgacggtgagttctggcacttcatgaacaacgaaactttcgagcagctgtctgctgatgcaaaagcaattggtgacaacgctaaatggctgctggatcaggcagagtgtatcgtaactctgtggaatggtcagccgatctccgttactccgccgaacttcgttgaactggaaatcgttgataccgatccgggcctgaaaggtgataccgcaggtactggtggcaaaccggctaccctgtctactggcgctgtggttaaagttccgctgtttgtacaaatcggcgaagtcatcaaagtggatacccgctctggtgaatacgtctctcgcgtgaagtaatgcggttgtggtgcggcctgcaggctgcaccatcacttattcaggtcagagatgatgaaacgccttatcgttcttgttttgcttgccagcacgctgctcacgggctgtaacaccgctcgcggtttcggcgaagacatcaaacatctcggcaactccatctctcgcgctgccagctaatttttcttctcttccgaaaaatcatcagattcccatcatttttggcgatgttgtctattattaatttgctataggcaaacataaataacattacctaaaaggaagacgttatggtgaagaagacaattgcagcgatcttttctgttctggtgctttcaacagtattaactgcctgcaacaccacgcgtggcgttggtgaagacatttctgatggcggtaacgcgatttctggcgcagcaacgaaagcgcagcaataagcaataacggtacgacagctgtgtcgtgccgtttgttttttctgcgatagtcacaaaggtaatagttgaaattcccctgccacctggcaaaatatccgttcaaccatcagctttgcaggacgacctgcaaacgcctcttttcaccggggacggccccaattctccggagcctgatatgtcctggattatcttagttattgctggtctgctggaagtggtatgggccgttggcctgaaatatacccacggctttagtcgtttgacgccgagtgttattactgtgacggcgatgattgtcagtatggcgctacttgcctgggcgatgaaatcgttaccagtagggacggcttatgccgtgtggacgggtattggcgcagtcggcgcggccataaccggcattgtgctgctcggtgagtccgctaacccgatgcgcctggcgagtctggcgttaatcgtattggggattattggtctgaaactcagcactcactaactaccaggctgctgtacccaaataaatttactgacatcaaacccttcccgggtcgcgactgccagcatctcctgtttcacttcgtcagaaatggttggcgtgcgggagagtatccacaggtagtcgcggtccgggccgcaaaccagcgcatggcggtattcccgatcgagtgcaataacgttataaccgccatagaaaggaccaaagaatgacactttcagcgcagcgcgagttggtgcgccggtaaagtacgctttcccttcactctgctgccacattcctctgtcagggttatagcctttattaatgacattcaggccgccgtcatcacgcaggctgtatgttgcggtgactttttccagtccacgttcaaagcggtgatcaaaacgggcaatctcataccaggtaccgagataacgtttggcgtcgaaattatttactacggtcacgccacgcggcggcgtaggagaactgcaggcaacgaccagaaatgcagctgtcgctgcggcaacgagagggagcaggcgcataaatgtttccttactggtttttttctaagtgtagatgacagcaaggaaaagcggagaaaaggtccgaaaattcggacccgatggaattttactgtagagcgttaagaatctgccaggcggcgtcgactctcgctggattgggatagtttttgtttgccagcatcacgatacccagctctttttctggaataaacgcgacatagctaccaaatccgccggtcgcccctgttttatgtacccatgatgcgcgtactgcaggagttgggggcgtaatcgcttttacggggcgtgctgccagtgcaattttattgtcactgccgttaatgatgctgtcaggatttaccggccagtccagcatttcccagcccaggccctgatacatatcgccggtttgccagtagcgagattgtgccagttgtatcccttgttgaagcgttttctcattgatatcaaggggttttaaattgctttgcacccagcgggccatatcttcaatggtcgacttcacaccataagcttcagcatctaacgccccaggcgaaacatgcactgccttaccttcgcgatatccccaggcgtaattcttttcttctgcgggcggtacattaatccacgtatggttgagtttgagtggctggaagacacgagtttgcatcgcctgctcaaaactcaaaccagacggcttcacagccagtgcgccgaacaaaccgatactggagttggcatacagacgttgtgttcctggagcccatgcaggctgccagttttgatagaagcgcagcaagtcgcttgaggatttcacctcatccggcacctgcaatggcaggccgccagcagtgtaggttgcgagatgtaatagtgtgatcccattccactgtttagcggtaagttcaggccagtattttgttgtgggatcgcttaacttgatttcccctcgagcaatagcgtcgccaccaagcacgccagtaaatgttttgctgaccgaacctaactcaaacaacgtttgctgtgtgacgggctgctttttggcgatgtccgcatagccccaggtaaagtaataaggtttaccctgataaattaccgccaccgccatacccgggatcttttgttgctctataagcggggtaattgtgcgatgcacaatatcgttgatttgttgaggggcagcaaatgtggagcaagaggcggtaattaataaggcgcagagcgtcgttttgaacatagggtctggtttccatacaaaacggcccgccataggcgggccggatttacattggcgatgcgttagattgtaacgacaccaatcagcgtgacaactgtcaggatagcagccagaccgtagaaaacccatttgcccgcaggtacgtggattttcagatcgtgcatcgcgtggtgcatacggtgtaaaccacaccacagcggcagaacgatcatcaggaacaggaatacgcgaccaatgaagctctgcgcgaacgccagaacgcgctcgtagctcagcgcatcacccggaaacaaccccagtggcagcagaatacccaccagcaggatcatcaccggcgcaatgatggcgctccacataccaccggccccgaagaggccccagaataccggttcgtcagaacgctttggatttggattaatcatctcaggctccttaccagtacagggcaacaaacaggattacgatggtggcaaccacagttaccgcccagagacttttgataattggctctggtcccattttttcgtcttttacaatgatattggccgctttcggtgccagttcaaaccaggttttggtgtgcagcagagctgccgccagagtgatcaggttaatgatcacgataaccgggttttgtaaaaagtcgacgaatcccgcccaggcttccgggccatttttcagggcaaacagcccgaaaatcagttcaatgctgaaccacacagccggaaccgccgtgccttcgcgcagcatgtaaaagcgataaaacggcaattttttccaccaggtggacgtcattggccgtacatacggtttacgtttagtcgtcatgttgcactccttagcgtggtttcagggtcgcgataagaaagtctttcgaactttctactttgccctgctgaatggccgcagccggatcgacgtgtttcgggcagacttcggagcagtagcccacgaaagtacagctccatacgccgttctggctgttcaactgcgccatacgctccttcttaccgtggtcgcggctatcttcgttataacgatgcgccagcgtaatggcagccggaccgatgaactctgggttcaggccaaactgcgggcacgcggcgtagcacaaaccacagttgatgcaaccggagaactggtgatacttcgccatctgcgccggggtctggatgttagtaccctgatccgcggtgcgggagttgccgatgatgtacggtttgatcgcttccagactttcgatgaagtgggtcatatcgaccaccagatcgcgttcaatcgggaagttagctaacgcttcaaccttcataccgtcggtgtaatcacgcaggaaggttttacatgccagttttggcacgttgttaaccatcatgccgcaggaaccacaaatcgccatacggcaggaccagcggtagctcaggtccggtgccaggttgtctttgatgtagcccagcgcatccagtaatgaggtagttgcgtcataaggcacttcatagaatgcgctatgcggtgcggtatcgacttccgggttatagcgcaccacctcaattttcaggtttttcatctcagccattcgccttctccttcttattggctgcttccgccttatcggctgcatccgcttcgccaccgtaaacgcgtttagctggcggcagcgtagtaatcttcacgtcgctgtactccaggcgagtcgtgccatcagcatcgcggaaggcgagggtgtgtttgaggaagttgacgtcgtcacgctcggtgcaaccttcgtccagacgctggtgcgcgccgcgggactctttacgtgccattgcggagtgcgccatacattcagcaacgttcagaccgtggcccagttcaatggtgtagagcaggtcggtgttgaacacgctggaagtgtcggtgatgcgcacgcgcttgaagcgttcctgcagctctgccagcttgtcgatggttttctgcatcagttccggcgtacggtagataccgcagccttcttccatagccaggcccatttcgtcgcggatcttcgcccagttttcgccgccatcctggttaaccagatctttcagacgttgttcaacgccagctgcctgcgcttcaattgccgcttcgttgccattaccggcagttgctgcacgctctgtcgcttgttcaccggccagacggccgaagaccaccagttccgccagggagttagaacccagacggtttgcaccgtgcagaccaacagaggaacattcacccacggcgaacagacctttaatgcgggtttcacagttctgatcggtttcgataccgcccatggtgtagtgtgcggtcggacgtaccggaatcggttctttaaccggatcgacgccaacgtacgctttcgccagttcgcagatgaacggcagacgttcatgcagttttttctcgccgaggtgacgcaagtcgagataaaccacatcgccacgcggcgtggagatggtgttgcctttacgccattcgtgccagaaggcctgagagactttgtcgcgtggacccagttccatatatttgtttttcggctcgcccagcggagtttccgggcccatgccgtaatcttgcagataacggtagccatttttgttgaccagaataccgccttcaccgcggcaaccttcggtcatcaggataccggaacctggcagaccggttgggtgatactgaacgaattccatgtcacgcagcggaacgccgtggcttagcgccatacccataccgtcaccggtaacgatgccgccgttggtgttgtaacgataaacgcgacccgcaccgccagtagccataacgaccgcgttagcacggatctgcaccagcgtgccttccatcatgttcattgctaccaggccgcgaacatgaccatcatcaaccagaatatccagcacgaaatgttcgtcaaaacgctggatctgcgggaattgcagagaggtctggaacagcgtgtgcagcatatggaagccggtcttatcggcggcgaaccaggtgcgctcgattttcatgccgccgaagcgacgtacgttgacgctaccatccgggcgacggctccatgggcatccccacagttccagttgggtcatttcggttgggcagtggtggacgaaataatccacgacatcctgctcacacaaccagtcgccacccgctactgtatcgtgaaagtgatattcgaagctgtcatgatcctgcgcgacagcggcggagcccccttctgcagcaacggtatggctacgcatcgggtatacttttgagattagtgcgatttttgcattcggatttgcctgcgcggcagcaattgcagcacgtaatcccgcgccaccggcgcctacaatggcaagatcggcttgaaaggtttgcacgacattcctccagattgtttttatcccacagccacgtacttcagggtaagtacctgaaagttacggtctgcgaacgctattccactgctcctttataggtacaacagtatagtctgatggataagtctgaaatttgacgagatcgatttttttagtgcgcaagagggctaaattatcactgaagatgattaatttaattactaaaccatcagatcgtgctttttttagtcactgcccaccgctgtttgattcctgcgtaaaatttgtctcgccgtcgcgttgcgagtagacttcgtgcccttgtcaaaaactggagatttaactatgagcgaaacggcatcctggcagccgagcgcatccattcctaacttattaaaacgcgcggcgattatggcggagatccgtcgtttctttgccgatcgtggagtgctggaggtggagacgccttgtatgagccaggcgacggtaaccgatattcatttggtcccgtttgagacacgtttcgttggccccgggcattcgcaggggatgaatctctggttaatgaccagcccggaataccatatgaaacgcctgctggttgccggttgtgggccggtattccagctgtgccgcagcttccgtaatgaagagatggggcgttatcacaaccctgagttcactatgctggagtggtatcgaccgcactatgatatgtaccggttgatgaacgaggtggacgatctcttacaacaggtgctggactgcccggcagcagaaagcctttcttatcaacaagctttcttgcgttatctggaaattgacccgctctctgccgacaaaacgcaactgcgggaagtcgcagcgaaactggatttgagcaatgttgctgataccgaagaagaccgcgacacgctgctacaattgctgtttacctttggcgtagagccaaatattggcaaagaaaaaccgacctttgtgtaccactttccagccagccaggcatcactggcgcaaatcagtaccgaagatcatcgggtcgctgaacgctttgaggtttattataaaggtattgagctggcgaatggtttccatgaattgacggatgcccgtgagcagcaacaacgctttgaacaagataaccgtaagcgcgcggcgcgcggtttgccgcagcaccccattgaccagaatctgattgaagccttgaaagtcggtatgcctgactgttccggcgtggcattaggtgttgatcgtctggtgatgttggcgctgggcgcggagacactggctgaagtcatcgcctttagcgttgaccgggcataattctgaaaaattactgaattaacagcgaagaatggcgtgataagcgccattctgtagcatatgttttcatttttccgttaaaggccacaatttaagactggatatttgatatcatccaggtatcaattctgtattggtttttacgctgcctgctcaatgttgcgcagtgcagttcagtgggcacgtgttatacacgcgctgaaatgaaggatggtttcatgcctcacacgataaaaaagatgagtctgataggactcatattgatgatctttacttccgtatttggatttgccaatagcccatcggcttattacttaatgggttatagtgcgattcccttttatatattttctgcattgttattctttattccattcgccttaatgatggctgaaatgggagctgcttatcgcaaagaagaaggcggtatctattcctggatgaataatagtgtcggaccacgttttgccttcattggtacgtttatgtggttttcctcttatatcatctggatggtgagtacctccgcgaaagtttgggtaccgttctcaacattcctctatggtagcgacatgacccagcactggcgtattgccggactggagcctacgcaggtggttggtctgctggctgtggcatggatgattctggtcaccgtcgttgcttctaaggggattaataaaattgcccgcattactgcggtgggcggtattgcagtaatgtgtctgaatttagtattgctgttagtaagcattactattttgttattaaatggtgggcatttcgcgcaggatattaatttccttgcatcaccgaacccgggttatcagtccggtctggcaatgctatcgtttgtggtatttgccatttttgcctatggcggaattgaagcggttggtggtctggtcgataaaacggaaaatccagaaaagaactttgccaaaggtattgtttttgccgctattgttatttcaatcggttattcgctggcaatatttttatggggcgtcagcacaaactggcagcaggtattaagtaatggttccgttaacctcggcaatattacctatgtgctgatgaagagccttgggatgacgctgggtaatgcactgcatttgtcacctgaagcgtcattgtcgctgggcgtatggtttgcgcgtattactggactttcgatgttcctcgcctataccggtgcgttctttacgctttgctattcaccgttgaaagccatcatccaggggacgccgaaagcattgtggccggaaccgatgacgcgcctgaatgcgatggggatgccgtctatcgccatgtggatgcagtgcgggttggttactgtcttcatcctgctggtttcgtttggtggcggtaccgcatcggcgttctttaacaagctgacgctgatggcgaacgtgtctatgacgcttccttacctgttcctcgcgctggctttcccgttctttaaagcacgtcaggatctcgacagaccgtttgtgattttcaaaacgcatttgtcggcaatgattgcgacagtggttgtcgtactggtggtgacatttgcgaacgtcttcaccatcattcaacctgtggttgaagccggagactgggacagcacattgtggatgattggcggccctgtcttcttctcgctgttagcgatggcgatttaccagaactattgcagcagagtggcaaaaaatccgcagtgggcggtggaataacccgatgccctatcgtctacctgacgatagggcgtaaagacaggaaatgttatggatgacaccagccgggacccggcaataaccgaagatgaaatcagggcgctgcaattttctgccggggatgtagcggaaatagagcagacgattctctcttttgtcgatgcctgccacacccgtaaagtggcgatggtggtgggtagcaccattaacaccctcaaagatcgcgatggtaaacggtggggaaacctgccggatatttattgcgcttatcttatccgatgtctggtttttcgcggggaattagtgggatacggcgatttgtttcgtatgcgctatagcgaaattaagcgaccggttaccttatgagtgcgcgcatgtttgtcttatgctgcatctggtttattgtggcgttcctctggataaccatcacttccgcgctggacaaagagtggatgattgatggacgcgggattaacaacgtctgcgatgtgttgatgtatctcgaagaagacgatacccgtgatgttggtgtgataatgacgttaccgctctttttcccttttctctggttcgctttgtggcgaaaaaaacgcggctggtttatgtacgccaccgcgctggctattttcggctactggctgtggcagttttttctgcgctatcagttttgtttgtgagccggattggttcatccggcacacaaacttacaaacttcccgcctgacgacctttgcccgcagacgtcagcgttctccccgtttgtttaccgttgaggctttccagacgcatctggaagggcgggaatggcatatcgataccgtgggcatggaagccagccagaatcagctggtggatctcatggcgtagcggcatacggtgacccatctcagcggcgtaaatacgcagctcgaaaatctgaatcccctgttgcagatccaccaggaagacttccggtgccgggttgtcgatcaccagcgagcagcgacgcgctgcggtgagcaggatttccgtcacttcttcgctattggcatcggcaggggccggtatcgtcaacaccacgcgcgtgaccgagtcagagagcgaccagttgataaactgctcggtaataaacgccttgttcggcacgattatctctttacggtcccagtcgctgatggtggtggcgcgggtgttaattttcgtcacgctaccggtgagatcgcgaattgtcaccgtatcgccaatgcgaatcggtttttcgaacaggataatcagaccagagataaagttggcgaaaatttcctgcaaaccaaaaccgagaccaacaccgagcgcggcaaccagccactgcaatttcgaccactcaataccaatcattgagaagccgaccagcccgccaatcagcatcagcagatatttggtgatggtggtgatggcgtaacccgtacccggcgttaaatccaggtgctgcaaaatcgccagttccagcagcgcgggcaagttgcgcaccagctgcgtggtgatgataaacaccagaatggcaatcagcaccgcaccgagggtaattggctccagactttctacgccctgtaccgtggaggtgacatcccacagcgaaatattttcgaggaagccgaaagcggaatggatttctgaccacagcacaatgacagaaagcagggcgatcaacatcaaaattgagcgcaccagccgcaaggattgcgcactgatggcatcgagatcgacttcgctttcatcgacttcaattgctccttccgggctactgtgatgatgcgcttcctcttcgccacgcgcacgttgcgctaacatctctgcccggcgatgcttcgcccgatcaaacgccagcctgcggcgctggatcagcatccagcggcggataacgtgataaaccaccagtagcaggaaccagatggcaaccgaggtttcaagcctcgctaacagcgcctgtgccgttgccagataacccaccgccgacgccagaatggcaaccaacggcgcgccaatcatcatgttccacagcatatggttggtaatgttgtcgccgctgccctctttgttgagatacagcggaatcccggcctttttcaggctgagggtgaccaccgccagcgcaccgcaaatgaggataaagcaaagccgtcccagcgaaccggagaattcacggtcgtcgaggttatcgaacatcatcagcgccataatcagcggcacaataagcccgatgctcatcaggtagtagcgcatcccacgggaaacacgttcgcgcggccagccaaaatgagcgataaacaagccgttcgggcgggcaaaggtggcgcaaatcatcactacccacagcagcggcacggtggccgttacaccatcgccaatcgcgaccgccagcggataaggccacgcctcgcgcaagccgtaacccagcgtcatccacagcaccggtaacggtgacgcgacgagaatcgaccagaaaagagtgcgcaacgtcagccagaagtgatcctgagtcactttgccaactttcgccgccgaacgttcaagaaaacgggtgaaatagcggcgcgagtaaatactgcaaccgaccagaatcaacgcgccaaacagcggcaaaattgtctctttgctggtcagcatcatcacactggctttgcccaactgactgaaggtgtccagcgaaatgagacgacgcagatcctgggcgatttccagcggccaggcgatggtcatcgggcgcacgtcagaggtccagaacagatagcggtgcgttgcttcgttcacctctttcagcgcatcctccagttgcccgttggagactttcagcttggtcagttccaatagtagcgtgtcgccaccctgcaacaatgagttcagcaactcacgctgagtgcgcagttgtgcttccagaatacggttttgctcggcagtcagcggctgaccgtcggcctgatgaatttgccgtagcagcggctgtttattaagcagatcctcataacgtaaccgttgcacacgcaactgcgccatttcggtatcaagctgttgtggtttcggcatttccggcagccgtgccacctgcgcccgcagcgcttcgccgagcagattggacgatcccagccattgcgactgttcacgcagcgtattcaacgcctgccggacctgtaacgtctggctggcagcctgacgctgttgcgaggcaacgagatccatccgctgcgcctgttgattcaaagccgccgatagttcgcggttaattttgaattgcgcgacgatatctttcggcaaatcggcgctgttttctgccagcaattcggtactttccagcgcccgctccgcctcaagctgacgttggctgtttaattgattacgcaaggcctgcaaatacgcatccagttgctggctctctttttccgccagctctgagcgtaagcgcgctaattcctggcggttattggcagacagctgcgccagctccagttcatcaacgagcgccttaagacgtgcagagtcagactgcaacgcgaaattttgtgcctgattgagcggagtattgccggtaagcgttcccaggcggcgctcgatctcatttaactgacggcgggcgtcggtttgctgttgcggcagttgattcagcgaatcggcaatctcgcgggcgcgctcctgctcttgctgggcctgacggcttttatccagcaactggctgctgacctggagaatttcctgattcagcgcgtcggtagacattcccggcgacacgctgcgcggctcgtcacgcatgttgtttaattgtgcgcgcagagtagcggagagtttcggataattatcgataacttgctgatattgtttgatgcgctcaagggaaccttttcgttcctcaagcgcatttaaggcagactggagcgcctctacgacttccggctgtgcgggtttcgccgcttttgcctgctccagttcctgagtgatttgtttgctatcgggggccgtcgcggcgtacgccccccaactgaggcaccaggccatcagaaaagtgataatcaggcgcacgtcagcgtttcctttgatggattagacctggtcttttttgtcgtcaaccaatgggctggcgtcgtgttctgcttcgatctcttcagcaggaagcggggcaggttcagcgtctggcgtaacaaaggtttcggtagatactgccagcggctggccaattttcgtgacagacaggctttccagttgctcaaccagattcactttacccggtgcaaacaggttgataacggtggaaccgagtttaaagcgacccatttcctggcctttcagcagtgccacagaaccgtcgttttccccggcaggccaggtccagcgcttgatgataccttcgcgcggcggcgtaatggtgcccgcccagaccgtctcaatgctgccaacaatcgtcgctccgaccagaatctgcgccattgggccaaattcggtatcgaaaaggcaaatcacgcgttcgttacgggcaaacagattcggcacgttctgagccgtgagatggttaacggagaagagatcgcccggcacgtagatcatctcacgcagaataccgttgcacggcatgtgtacgcggtggtagtcacgcggggagaggtaagtggtcacaaacgtaccgttgcggaacaggtccgccatcagatagttgcctgccagcagggcttcgaggctgtagttgtggcctttggcttgcaggattttatcttcttcgattttacccaactggctgataacgccatcggcaggcatgaccagtacattcggatcggtatcgattgggcgtacttcgtcacgcagcggacggacaaagaattcgttaaaggtgcggtagctggcggtgtccggcttttgcgcctctttcatgtcgaccttgtagtatttaacgaacagatcgataaccagttttgtcagccatcctgcccgcttgcttgcgccccaacccgccaggcgagtaagccatagtttcggcagaatgtactgtagcgaaagtttaaatgaatttaacaaggtagcctccaggccattgttttgtcgttcctgatccggcctacatgccggatcctgaaaaaaaggggacgattctaacgacggttagcttaattgtcagtcatccgtatcagaaaagtttttacgcgtttttacctgcgccatgctttccagaatacggtgatagttttcgaaacgggtttccgcgattttcccttcctcaaccgcttcccggatagcgcagcccggatcggtatcgtgtttgcaatcgcgatatttacacagacctaaatagtcatggaattcgacaaagccctgagtgatttgttccggctccaggtgccagaggccgaactcacgcactcctggggagtcaatcacatcaccgccgtgcgggaagtgatacagccgagcggcggtcgtggtgtgctgaccgagccccgagttgtcagagatatcgttggtcaggatctctttttgcagccccagcaacgcattcagcaggctggatttgccgacgccagactgcccggcaaaaatgctgatgcgcccggtcaacgcctcttccagcggttttagcccatcctgagtatggctggaaaccatcaatacgcgataaccgatattgcggtagatatccatctgctcgttgacgaacgccatgccttcgtcgtccagcaggtctatcttgttgagcacaataatcggctcaatctgcaaggtttcgcaggccaccaggtaacggtcgataatattgagcgacagctccggcaaaatggcggagacaatgacaatctggtcgatgttggcggcaataggttttacgccgtcgtagaaatccggacgcgtcaacaccgaggtacgctcatgcaccgcttccacgatccctttgacatttacgccttccgccgccggtttacccggacgccagactacgcggtcgccggttaccagcgaacggatggtacggcgaatattgcagcggtgaacgtcgccatcggcggattccacatcagcgtgcataccaaagcggctgatgacgataccttcatcaggctcgccaaacagattgtcgtcgtagtcgggcttctccttagacgttttaagacgacgctggtgattggcgttcacgcggcgctgctggcctttggagagtttatttttactcaatcgtacagactcctggtcgcccctgatgggcaaaacatctatgatacacgcaattgtggatcaatatagtcactgtgaatgggtggaaaatagcatgagtgccaatgaaaacaacctgatttggatcgatcttgagatgaccggtctggatcccgagcgcgatcgcattattgagattgccacgctggtgaccgatgccaacctgaatattctggcagaagggccgaccattgcagtacaccagtctgatgaacagctggcgctgatggatgactggaacgtgcgcacccataccgccagcgggctggtagagcgcgtgaaagcgagcacgatgggcgatcgggaagctgaactggcaacgctcgaatttttaaaacagtgggtgcctgcgggaaaatcgccgatttgcggtaacagcatcggtcaggaccgtcgtttcctgtttaaatacatgccggagctggaagcctacttccactaccgttatctcgatgtcagcaccctgaaagagctggcgcgccgctggaagccggaaattctggatggttttaccaagcaggggacgcatcaggcgatggatgatatccgtgaatcggtggcggagctggcttactaccgcgagcattttatcaagctgtaaaatttttcctggtcacgtaagcgccggaatccacttgcggcggcgtgattttgacgctaaattgaacgtcttgctgataatttcagcacttgagataaaaacgcaaaaaaaacttttttggggggttgcagagggaaagatttctcgtataatgcgcctcccgtaacgacgcagaaatgcgaaaattacgaaagcaaaattaagtagtacgcgggaatagctcagttggtagagcacgaccttgccaaggtcggggtcgcgagttcgagtctcgtttcccgctccaaaatttgaaaagtgctgcaaagcacagaccacccaagcgggaatagctcagttggtagagcacgaccttgccaaggtcggggtcgcgagttcgagtctcgtttcccgctccaaaatttgaaagtgctgtaaggcacagaccacccaagcgggaatagctcagttggtagagcacgaccttgccaaggtcggggtcgcgagttcgagtctcgtttcccgctccaaattcttctctcaataaaatatccacagcgacgcgatgcgttattgctggtttttgttgtctctgacaaactcttgtaaacagagttatccacagcctcaggctgtaatcttaatttcaaagaaacttcgcacggtgaatagtatttttttaacctattgatagataagttaaaaattaagattccgttttgtcgagtcgatcacttgacgattttattcgtcttgaattgcaatgcgtttttatttttattcacaagctgtggatgaatcaggcgtcacgcggtaaccctttttcaatcacccgaaccagacgctgttttttcggcaattgcacttcgactatgcacgcatttcgtctctctatttgctgcgcaatcgcccacgctatgtgctcatcgagaagtgggtgctcacctttacgactttccagcgctgtcaaaatcgtttcatcccaaggggcattgcctaatgctacggcgatattacgcagccaacgcaggtgaccaatacgacgaatcgccgatccttccgtgacttttaaaaacttctcttcgctccaggcgaataactcaatgagttccggtgcgtgtagcggcttacgcgggctgaaatcctcttctgtggtgagttgtgaatagcgattccacgggcagataagctggcagtcatcgcaaccgtaaatacggtttcccattaacggtcgcaactcttccgggatcgccccttcaagttcgatggtgagataagagatacagcggcgagcatcgacggtatatggctcgacgatggcaccggtcgggcaaatcgtcatacaggccacgcatttgccgcatccttcctcgactggttgatccacgggcagcggaatatcgaccagcaattcgcctaaaaagaagaacgaaccggcctcgcgattgaggataagtgagtgcttacctgtccagccgagcccagctttttcagctaacgggcgctcgagaataggcgcagaatcgacaaacggtctaaaattcagcgaaacacaatgttgctgaatcatctcgcccagctttttgagtcggttgcgcagaagtttgtgatagtcacggcccagcgcataacggctaacatagccgagtttggggtttttcagcgtgctggcaaatgcggcgttagcaggaaggtaattcatccgcacgctgatcacgcgcagcgtaccgggcaataactcatgagggcgagcgcgcagcataccgtgacgtgccatccagtccatttcgccgtggtattgtttgtccagccatgcttgcagtttgggctcggactcgctgagatcggtatcggtaatacctacctgctgaaagcccagttccagcccccactgtttaattttttgcgctaactgattgagatcgaggggctctgacatgacggaccatacaatgaagaaaaaccccgtaagtataccacacaccgtctggtacgccgacgatatccgccgcggagaacgcgaggcggcagatgtgctggggctcacactctatgagctgatgcttcgcgctggcgaggccgcattccaggtgtgtcgttcggcgtatcctgacgcccgccactggctggtgctgtgcggtcatggtaataacggcggcgatggctacgtggtcgcgcgactggccaaagcggtcggcattgaggtcacgttgttggcccaggagagcgacaaaccgttgccggaagaggccgcgctggcacgcgaagcatggttaaacgcgggtggcgagatccatgcttcgaatattgtctggcccgaatcggtagatctgattgttgatgcgctgctcggtaccggtttgcggcaagcgccccgcgaatccattagccagttaatcgaccacgctaattcccatcctgcgccgattgtggcggttgatatcccttccggcctgctggctgaaactggcgctacgccaggcgcggtgatcaacgccgatcacaccatcacttttattgcgctgaaaccaggcttgctcactggaaaagcgcgggatgttaccggacaactgcattttgactcactggggctggatagttggctggcaggtcaggagacgaaaattcagcggttttcagcagaacaactttctcactggctaaaaccgcgtcgcccgacttcgcataaaggcgatcacgggcggctggtaattatcggtggcgatcacggcacggcgggggctattcgtatgacgggggaagcggcgctgcgtgctggtgctggtttagtccgagtactgacccgcagtgaaaacattgcgccgctgctgactgcacgaccggaattgatggtgcatgaactgacgatggactctcttaccgaaagcctggaatgggccgatgtggtggtgattggtcccggtctgggccagcaagagtgggggaaaaaagcactgcaaaaagttgagaattttcgcaaaccgatgttgtgggatgccgatgcattgaacctgctggcaatcaatcccgataagcgtcacaatcgcgtgatcacgccgcatcctggcgaggccgcacggttgttaggctgttccgtcgctgaaattgaaagtgaccgcttacattgcgccaaacgtctggtacaacgttatggcggcgtagcggtgctgaaaggtgccggaaccgtggtcgccgcccatcctgacgctttaggcattattgatgccggaaatgcaggcatggcgagcggcggcatgggcgatgtgctctctggtattattggcgcattgcttgggcaaaaactgtcgccgtatgatgcagcctgtgcaggctgtgtcgcgcacggtgcggcagctgacgtactggcggcgcgttttggaacgcgcgggatgctggcaaccgatctcttttccacgctacagcgtattgttaacccggaagtgactgataaaaaccatgatgaatcgagtaattccgctccctgatgagcaggcaacattagacctgggcgagcgggtagcgaaagcctgcgatggcgcaaccgtaatctatctgtatggcgatttaggcgcaggtaaaaccacctttagccggggctttttacaggctctgggtcatcagggtaatgtcaaaagccccacttatacgctggtcgaaccctatacgctcgacaacttaatggtctatcactttgatttgtaccgccttgccgatcccgaggagctggagtttatggggatccgcgattattttgccaacgatgccatctgcctggtggagtggccacaacaaggtacaggtgttcttcctgacccggatgtcgaaatacacattgattatcaggcacaaggccgtgaggcgcgcgtgagtgcggtttcctctgcgggtgaattgttgctggcgcgtttagccggttaacctttgaaaggtggcgggatgatgtatcgcatcagaaattggttggtagcgacgctgctgctgctgtgcacgccggtgggtgccgcgacgctctctgatattcaggtttctaacggtaatcaacaggcgcggataacgttgagttttattggcgatcctgattatgcgtttagccatcaaagcaaacgcaccgtggcgctcgatatcaaacaaacgggcgtgattcagggactgccgttgttgttcagcggcaataatctggtgaaggcgattcgctctggaacgcctaaagatgcacaaacgctacggctggtggtcgatcttaccgaaaacggtaaaaccgaagcggtgaagcggcagaatggcagcaattacactgtcgtctttacgattaacgccgatgtgccgccaccgcctcctccgccgcccgtggttgcgaaacgcgttgaaacgcctgcggttgtcgcaccgcgcgtcagcgaaccggcgcgcaatccgtttaaaacggaaagtaaccgcactacgggtgttatcagcagtaatacggtaacgcgtccggcagcgcgcgcgacggctaacactggcgataaaattatcatcgctattgatgccggacacggcggtcaggaccctggcgctatcggccccggtggtacgcgggagaaaaatgtcaccatcgccatcgcgcgtaaattgcgtactttgctcaatgacgatccgatgtttaaaggcgttttaacccgtgacggggattactttatctcggtgatggggcgcagtgatgtggcacgtaagcaaaacgccaatttcctcgtgtcgattcacgctgatgccgcaccgaaccgcagtgcgactggcgcttccgtatgggtgctctctaaccgtcgcgccaacagtgaaatggccagctggctggagcagcacgagaaacagtcggagctgctgggtggggcgggtgatgtgctggcgaacagtcagtctgacccctatttaagccaggcggtgctggatttacagttcggtcattcccagcgggtagggtatgatgtagcgaccagtatgatcagtcagttgcaacgcattggcgaaatacataaacgtcgaccagaacacgccagccttggcgttctgcgctcgccggatatcccatcagtactggtcgaaaccggttttatcagcaacaacagcgaagaacgtttgctggcgagcgacgattaccaacaacagctggcagaagccatttacaaaggcctgcgcaattacttccttgcgcatccgatgcaatctgcgccgcagggtgcaacggcacaaactgccagtacggtgacgacgccagatcgcacgctgccaaactaaggacgattgatgccaattcaggtcttaccgccacaactggcgaaccagattgccgcaggtgaggtggtcgagcgacctgcgtcggtagtcaaagaactagtggaaaacagcctcgatgcaggtgcgacgcgtatcgatattgatatcgaacgcggtggggcgaaacttatccgcattcgtgataacggctgcggtatcaaaaaagatgagctggcgctggcgctggctcgtcatgccaccagtaaaatcgcctctctggacgatctcgaagccattatcagcctgggctttcgcggtgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccacatcaggtggacgtcaacgtgcaccccgccaaacacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaattaaaagcgccggaaccgcaggaacctgcacttgcggcgaacagtcagagttttggtcgggtactgactatcgtccattccgactgtgcgttgctggagcgcgacggcaacatttcacttttatccttgccagtggcagaacgttggctgcgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggcagtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgatatcagtaaggcgagcctgcctaaggcgatttttttgatggggccgacggcctccggtaaaacggcgttagccattgagctgcgtaaaattttaccagtagagttgataagcgttgattctgcccttatttacaaagggatggatatcgggacggcgaagccgaacgctgaagagttactcgccgcgccgcaccgattgctggatattcgcgatccgtcgcaggcttactcggctgctgattttcgccgcgatgcgctggcggaaatggccgatatcaccgcggcggggcggatcccactgttagtgggcggtacgatgttgtatttcaaggcattgctggaagggttgtcgccgctaccgtcggcagacccggaagtacgggccagaattgagcaacaggcggcagagcaaggttgggagtcattgcatcgtcaacttcaggaggtagatccggttgcggcagcaaggattcatccaaatgatccacaaaggctttcccgggcactggaagtttttttcatttcgggtaaaactttaacggaactgacgcaaacgtcaggagacgctctaccgtatcaggtgcatcagttcgccatcgccccggcgagccgtgaactgctccatcaacgcattgagcagcgttttcatcagatgttggcttcaggttttgaagcagaagtccgggcgctttttgcccgaggagatttgcatacggacttgccttccattcgttgcgtgggttatcgccagatgtggtcttaccttgaaggcgaaatctcatacgatgaaatggtttatcgaggtgtttgcgccacgagacagttggcgaagcggcagataacctggctgcgtggttgggaaggggttcactggcttgacagtgaaaaaccagaacaggcgcgtgacgaagtattacaggttgttggtgctatcgcaggctgaatgtgtacaattgagacgtatcgtgcgcaattttttcagaatcgaaaggttcaaagtacaaataagcatataaggaaaagagagaatggctaaggggcaatctttacaagatccgttcctgaacgcactgcgtcgggaacgtgttccagtttctatttatttggtgaatggtattaagctgcaagggcaaatcgagtcttttgatcagttcgtgatcctgttgaaaaacacggtcagccagatggtttacaagcacgcgatttctactgttgtcccgtctcgcccggtttctcatcacagtaacaacgccggtggcggtaccagcagtaactaccatcatggtagcagcgcgcagaatacttccgcgcaacaggacagcgaagaaaccgaataaggtttcgggctgtttttttacacggggagccagcgatcctgcgttccccgctgatctatttagagggttatacgcttgtttgaccgttatgatgctggtgagcaggcggtactggtacacatctattttacgcaagacaaagatatggaagacctccaggagtttgaatctctggtctcttccgccggtgtcgaagcattgcaggtgattaccggtagccgtaaagcgccgcacccaaagtattttgtaggtgaaggtaaagcagttgaaattgcggaagctgtcaaagcgacgggtgcttcggtcgttctttttgaccatgccctgagcccggcgcaagagcgtaacctggagcgtttgtgcgagtgtcgtgttatcgaccgcaccggccttattttagatattttcgcccaacgtgcgcgtacccatgagggtaagttgcaggttgagctggcgcagctgcgccatctggctacgcgcctggtgcgtggctggacccaccttgaaagacagaaaggcgggataggtttgcgtggtccgggtgaaacccagctcgaaaccgaccgtcgtttgttgcgtaatcgcatcgtgcagatacagtcgcgcctggaaagagttgaaaagcagcgtgagcaggggcggcaatcgcgtatcaaagccgacgttcctactgtttcgctggtgggatataccaacgccggtaaatctacccttttcaatcgcatcaccgaagcgcgggtctacgcggcagaccagttgtttgccaccctcgacccgacgttgcggcgtattgacgttgcagatgtcggtgaaaccgtacttgcagataccgtagggtttattcgccacctgccgcacgatctggtggcggcatttaaagccacgttacaagagacgcggcaagccacattactgctgcacgtcattgatgcggcggatgtgcgtgtacaagaaaacatcgaagcggtgaatacggttcttgaagagatcgacgctcacgagatcccaaccctgctggtgatgaacaagatcgatatgctggaagatttcgaaccgcgtattgatcgggacgaagagaacaaaccgaaccgtgtctggctttccgcacagaccggagcggggataccacagctttttcaggctttgacggagcggctttccggcgaggtggcgcagcatacattgcgtctgccaccgcaggaagggcgtctgagaagtcgtttttatcagcttcaggcaatagaaaaagagtggatggaggaggacggcagcgtaagtctgcaagttcgtatgccgatcgttgactggcgtcgcctctgtaaacaagaaccggcgttgatcgattacctgatctaacggcgtagcgtctgaagcgtggagtcatatcctctggcgtcgaaagacaacagggatcaccgcataacaaatatggagcacaaacatggcgtggaatcagcccggtaataacggacaagaccgcgacccgtggggaagcagcaaacctggcggcaactctgagggaaatggaaacaaaggcggtcgcgatcaagggccacctgatttagatgatatcttccgcaaactgagcaaaaagctcggtggtctgggcggcggtaaaggcaccggatctggcggtggcagttcatcgcaaggcccgcgcccgcagcttggcggtcgtgtcgttaccatcgcagcggcagcgattgtcattatctgggcggccagtggtttctataccattaaagaagccgaacgcggcgtggtaacacgctttggtaaattcagccatctggttgagccgggtctgaactggaaaccgacgtttatcgacgaagtcaaaccggtgaacgtggaagccgtgcgtgaactggccgcttctggtgtgatgctgacgtcggacgagaacgtagtgcgcgttgagatgaacgtgcagtaccgcgtcaccaatccggaaaaatatctgtatagcgtgaccagcccggatgacagcctgcgtcaggctaccgacagcgccctgcgtggagttatcggtaaatacaccatggaccgcattctgacggaaggtcgtaccgtgattcgtagcgatactcagcgcgaactggaagagacgattcgtccgtatgacatgggtatcacgctgctggacgtcaacttccaggctgctcgtccgccggaagaagtaaaagcggcgtttgacgatgcgattgccgcgcgtgaaaacgaacagcaatacattcgtgaagcagaagcgtataccaacgaagttcagccgcgtgcgaacggtcaggcgcaacgtatcctcgaagaggcgcgtgcgtacaaggcccagaccatcctggaagctcagggtgaagtggcgcgctttgctaaacttctgccggaatataaagccgcgccggaaattactcgcgagcgtctgtatatcgagacgatggaaaaagtgttgggtaacacccgcaaagtgctggttaacgataaaggtggcaacctgatggttctgccgttagaccagatgctgaaaggtggtaacgcccctgcggcgaagagcgataacggtgccagcaatctgctgcgtctgccgccagcctcttcctccacaaccagtggagcaagcaacacgtcgtccaccagtcagggcgatattatggaccaacgccgcgccaacgcgcagcgtaacgactaccagcgtcagggggaataacgatgcgtaagtcagttatcgcgattatcatcatcgtgctggtagtgctttacatgtctgtctttgtcgtcaaagaaggtgagcgcggtattacgctgcgttttggtaaggtactgcgtgacgatgacaacaaacctctggtttatgagccgggtctgcatttcaagataccgttcattgaaacggtgaaaatgctcgacgcacgtattcagaccatggacaaccaggccgaccgctttgtgaccaaagagaagaaagacctgatcgtcgactcttacatcaaatggcgcatcagcgatttcagccgttactacctggcaacgggtggtggcgacatttcgcaagcggaagtgctgttgaaacgtaagttctctgaccgtctgcgttctgaaattggtcgcctggacgtgaaagatatcgtcaccgattcccgtggtcgtctgaccctcgaagtacgtgacgcgctgaactccggttctgcgggtacagaagatgaagttactaccccggcggcagataacgccattgccgaagcggcagagcgcgtaacggctgagacgaagggcaaagttccggtcatcaacccgaacagtatggcggcgctgggtattgaagttgtcgatgtgcgtatcaagcagatcaacctgccgaccgaagtgtctgaagcgatctacaaccgtatgcgcgccgagcgtgaagcggtagcgcgtcgtcaccgttcacaaggtcaggaagaagcggaaaaactgcgcgcgactgccgactatgaagtgaccagaacgctggcagaagctgagcgtcagggccgcatcatgcgtggtgaaggcgatgccgaagcagccaaactgtttgctgatgcattcagtaaagatccggacttctacgcattcatccgtagcctgcgtgcttatgagaacagcttctctggcaatcaggacgtgatggtcatgagcccggatagcgatttcttccgctacatgaagacgccgacttccgcaacgcgttaatataacgactgcggtacaggtcaataaagccaccgcatcctcagggatgtcggtggttttctttttctataaggataatgaatgaattcgacaatctggctggcgcttgccctggttttggtactggaaggtttagggccgatgctttacccgaaggcatggaagaagatgatctctgcgatgaccaatttgcccgataatattttacgtcgttttggcggtggacttgtggttgcgggcgttgtggtctactacatgttgaggaaaacgattggctgaacaaaaaacagactgatcgaggtcatttttgagtgcaaaaagtgctgtaactctgaaaaagcgatggtagaatccatttttaagcaaacggtgattttgaaaaatgggtaacaacgtcgtcgtactgggcacccaatggggtgacgaaggtaaaggtaagatcgtcgatcttctgactgaacgggctaaatatgttgtacgctaccagggcggtcacaacgcaggccatactctcgtaatcaacggtgaaaaaaccgttctccatcttattccatcaggtattctccgcgagaatgtaaccagcatcatcggtaacggtgttgtgctgtctccggccgcgctgatgaaagagatgaaagaactggaagaccgtggcatccccgttcgtgagcgtctgctgctgtctgaagcatgtccgctgatccttgattatcacgttgcgctggataacgcgcgtgagaaagcgcgtggcgcgaaagcgatcggcaccaccggtcgtggtatcgggcctgcttatgaagataaagtagcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggtggttgacgtttctgacctgctcgaccaggcgcgtcagcgtggcgatttcgtcatgtttgaaggtgcgcagggtacgctgctggatatcgaccacggtacttatccgtacgtaacttcttccaacaccactgctggtggcgtggcgaccggttccggcctgggcccgcgttatgttgattacgttctgggtatcctcaaagcttactccactcgtgtaggtgcaggtccgttcccgaccgaactgtttgatgaaactggcgagttcctctgcaagcagggtaacgaattcggcgcaactacggggcgtcgtcgtcgtaccggctggctggacaccgttgccgttcgtcgtgcggtacagctgaactccctgtctggcttctgcctgactaaactggacgttctggatggcctgaaagaggttaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggcctgccgcaggcggcgctgaactatatcaagcgtattgaagagctgactggtgtgccgatcgatatcatctctaccggtccggatcgtactgaaaccatgattctgcgcgacccgttcgacgcgtaattctggtacgcctggcagatattttgcctgccgggcgaacagtgtgatacattgctgtgtcgggtaagccattacgctatccgacacagtgttaaatcctcgcttttttccttccccgaactgaaataaattagcgacacagcttgtggctggtttatcatcaatataaatgtattttttcccgatttcccttttgaggttgatgtgcagttaacgagtttcactgattacggattacgtgcgctgatctacatggcgtcattgccagaagggcggatgaccagtatttctgaagtgactgacgtctacggcgtctcccgtaatcatatggtcaaaataatcaatcaacttagtcgtgccggctacgtgactgctgttcgtggaaaaaatggcggcattcgcctgggtaaaccggcgagtgcgatacgtattggtgatgtggtgcgcgagctggagcccttatcgctggtgaattgcagcagtgagttttgccacattacacctgcctgtaggttgaaacaggcactttctaaggccgtgcaaagttttcttacggaactggataactacacgcttgccgatttggttgaagagaatcaaccgctttataaattattgctggtggagtgacgaaaatcttcatcagagatgacaacggaggaaccgagatgtcacaagatcctttccaggaacgcgaagctgaaaaatacgcgaatcccatccctagtcgggaatttatcctcgaacatttaaccaaacgtgaaaaaccggccagccgtgatgagctggcggtagaactgcacattgaaggcgaagagcagcttgaaggcctgcgtcgccgcctgcgcgcgatggagcgcgatggtcaactggtcttcactcgtcgtcagtgctatgcgctgccggaacgcctcgacctggtgaaaggtaccgttattggccaccgtgatggctacggctttctgcgggttgaagggcgtaaagatgatttgtatctctccagcgagcagatgaaaacctgcattcatggcgatcaggtgctggctcagccgctgggtgctgaccgtaaaggtcgtcgtgaagcgcgtattgtccgcgtactggtgccaaaaaccagccagattgttggtcgctactttaccgaagcgggcgtcggctttgtggttcctgacgacagccgtctgagcttcgatatcttaatcccgcccgatcagatcatgggcgcgcggatgggctttgtggtcgtagtcgaactgactcagcgtccgactcgccgcaccaaagcggtgggtaaaatcgtcgaagtgctgggcgacaatatgggcaccggcatggcggttgatatcgctctgcgtacccatgaaattccgtacatctggccgcaggctgttgagcaacaggttgccgggctgaaagaagaagtgccggaagaagcaaaagcgggccgtgttgatctgcgcgatttaccgctggtcaccattgatggcgaagacgcccgtgactttgacgatgcagtttactgcgagaaaaaacgcggcggcggctggcgtttatgggtcgcgattgccgacgtcagctactatgtgcgtccgtcaacgccgctggacagagaagcgcgtaaccgtggcacgtcggtgtacttcccttcgcaggttatcccgatgctgccggaagtgctctctaacggcctgtgttcgctcaacccgcaggtagaccgcctgtgtatggtgtgcgagatgacggtttcgtcgaaaggccgcctgacgggctacaaattctacgaagcggtgatgagctctcacgcgcgtctgacctacaccaaagtctggcatattctgcagggcgatcaggatctgcgcgagcagtacgccccgctggttaagcatctcgaagagttgcataacctctataaagtgctggataaagcccgtgaagaacgcggtgggatctcatttgagagcgaagaagcgaagttcattttcaacgctgaacgccgtattgaacgtatcgaacagacccagcgtaacgacgcgcacaaattaattgaagagtgcatgattctggcgaatatctcggcggcgcgtttcgttgagaaagcgaaagaaccggcactgttccgtattcacgacaagccgagcaccgaagcgattacctctttccgttcagtgctggcggagctggggctggaactgccgggcggtaacaagccggaaccgcgtgactacgcggagctgctggagtcggttgccgatcgtcctgatgcagaaatgctgcaaaccatgctgctgcgctcgatgaaacaggcgatttacgatccagaaaaccgtggtcactttggcctggcattgcagtcctatgcgcactttacttcgccgattcgtcgttatccagacctgacgctgcaccgcgccattaaatatctgctggcgaaagagcaggggcatcagggcaacaccactgaaaccggcggctaccattattcgatggaagagatgctgcaactgggtcagcactgttcgatggcggaacgtcgtgccgacgaagcaacgcgcgatgtggctgactggctgaagtgtgacttcatgctcgaccaggtaggtaacgtctttaaaggcgtaatttccagcgtcactggctttggcttcttcgtccgtctggacgacttgttcattgatggtctggtccatgtctcttcgctggacaatgactactatcgctttgaccaggtagggcaacgcctgatgggggaatccagcggccagacttatcgcctgggcgatcgcgtggaagttcgcgtcgaagcggttaatatggacgagcgcaaaatcgactttagcctgatctccagcgaacgcgcaccgcgcaacgtcggtaaaacggcgcgcgagaaagcgaaaaaaggcgatgcaggtaaaaaaggcggcaagcgtcgtcaggtcggtaaaaaggtaaactttgagccagacagcgccttccgcggtgagaaaaaaacgaagccgaaagcggcgaagaaagacgcgagaaaagcgaaaaagccatcggcgaaaacgcagaaaatagctgcagcgaccaaagcgaagcgtgcggcgaagaaaaaagtggcagagtgatcaataccctctttaaaagaagagggttagattgctgacaaaatgcgctttgttcatgccggatgcggcgtgaacgccttatccggcctacataatcacgcaaattcaatatattgcagagatcatgtaggccggataaacgtagtgcatcaggcaaaacgtaaacaacgagtacattaatgagcgaaatgatttacggcatccacgcagtgcaggccctgctggagcgcgcccctgaacgttttcaggaagtctttattttaaaaggccgtgaagataaacgtctgttaccgctgattcacgcccttgagtctcagggcgtggttatccagttggcaaaccgccaatatctcgacgagaaaagcgacggtgccgtgcatcagggcattatcgcccgcgtgaagccaggacgtcagtatcaggaaaacgatctgccggatctgatcgcttcgctcgatcaaccgttcctgctgatcctcgacggcgtaaccgatccgcacaacctcggcgcgtgcctgcgtagtgcggacgccgcaggcgttcatgcggtgattgtgccgaaagatcgctccgcacagctcaacgctacggcgaaaaaagtagcctgcggcgcggcagaaagcgttccgctgattcgggtgactaaccttgcgcgcaccatgcgtatgttgcaggaagagaatatctggatcgtcggtacggcaggcgaggcggatcatacactctatcagagcaaaatgaccggacgcctggcgctggtgatgggtgcggaaggtgaaggtatgcgtcgcctgactcgtgaacattgcgatgagttgatcagcatcccgatggctggaagcgtttcttccctgaacgtttcggttgcgaccggaatttgcttatttgaagcggtgcgccagcgcagctaatttctcagaattatgaaaagccatccagatttggatggtttttttttgtctatagctggtaagataattacgtattgcaaatattcattttattaatatttaaacttaatctatatggaataatatatgacatggaatccgttggcgctagcgacggcgctgcaaactgtacctgaacaaaatattgatgtaacaaatagcgagaacgcattaattattaaaatgaatgattatggcgatttgcaaatcaatattctttttacttcccgccaaatgattatcgaaacctttatttgtccggtgagtagtatcagcaatccagatgaatttaataccttcttattaagaaatcagaagatgatgccgttgtcatcggtagggatctccagcgtacaacaggaagagtattacattgttttcggggcgttatcgcttaaatcttctcttgaagatatcctgcttgagataacctcgctggtagataacgcattggatctggctgaaattacagaagaatattcacactaattacaaggacgggtatttatgggaattttaaaaagtttatttacgctggggaaatcgtttatctcccaggcggaagaatccattgaagaaacccagggcgtgcgcatgctggaacagcatattcgtgacgctaaagctgaactcgataaagccggaaaatctcgcgttgatctgctggcgcgggtgaaattaagtcacgataagctgaaagatttacgtgagcgcaaagccagtctggaagcccgtgcgctggaagcgttaagcaagaacgttaatccgtcgttgattaacgaagttgctgaagaaatcgcgcgccttgagaatctcattaccgctgaagagcaagtgttgtcgaatctggaagtctcccgtgatggcgtggaaaaagcagttacagcgacagcgcagcgtatcgctcagtttgagcagcaaatggaagtcgttaaagccactgaagccatgcagcgtgcacaacaggctgtaacaacctctaccgttggcgcatcttccagcgtttcgacagcggcagaatccttaaaacgcctgcaaacgcgtcaggccgaacgtcaggctcgcctggatgctgccgcacagttggagaaagtcgcagacggtcgcgaccttgacgaaaagctggcggaagccggaattggcggtagcaataaaagtagcgcccaggatgtattagcaagactgcaacgccaacagggcgagtaatttttttgccagcctcgctaaaaggctggcaactattttaaggataaaatatgtctggttttttccagcgtctgtttggcaaggataataagccagctatcgctcgtggtccgctgggacttcatctcaatagtggctttacgctcgacacgttagcgtttcgtttgctggaagatgaattgctgattgcgctgccgggtgaggaatttacggtagccgccgtcagccacatcgatctgggcggcggtagtcagattttccgctactacacttcaggcgatgagtttctgcaaatcaataccaccggcggcgaagatattgatgacattgatgatatcaagctctttgtctatgaagagagctacggtatcagtaaagagagtcactggcgcgaggcgatcaacgccaaagcgatgggagcaatgaccttaaactggcaggaaaaacgctggcagcgattttttaacagcgaagaaccgggaaatatcgaacccgtctacatgctggaaaaagtagaaaatcaaaaccatgccaaatgggaggtccataattttaccatgggctaccaacggcaagtaaccgaagatacttacgaatatttgctgctaaatggtgaggaatcttttaacgatctcggcgagccagagtggttattttcgcgcgcgttgggtgtcgatatcccgctgacatcacttcatattattggttaattacaaggacgtttacaatgcatatactggattcacttcttgcctttagcgcctatttttttattggcgtggctatggtgattatttttctgtttatctattctaaaattacaccgcacaacgaatggcagttaatcaaaaacaataataccgcggcgtcactggcgttcagcggtacattgttgggttacgttatccccttatccagtgcggcaatcaatgcggtgagtattccagactatttcgcctggggcgggattgcactggtgattcagttactcgtttttgctggtgtcagactttatatgcccgcattaagcgaaaaaattattaatcacaataccgcagcaggaatgtttatgggaaccgccgcgctggctggcggtatttttaacgcagcttgtatgacatggtaatggacgatcatggccagaaaacgcaaatcaagaaataacagtaaaattggtcacggagcgattagtcgcattggtagaccgaataatccttttgaaccgtgccgcaatcgctacgcacaaaaatacttaacgttggcgctaatgggcggtgccgcttttttcgtattgaaaggttgtagcgatagtagcgatgtcgataacgacggcgacggaacgttttacgcgacagtgcaggattgtattgatgacggtaataatgccgacatttgcgcgcgtggctggaacaacgccaaaacggcattttatgccgatgttccgaagaatatgactcagcagaactgtcagtctaagtacgaaaattgctactacgacaatgttgaacagagttggatcccggtcgtttctggatttttgttaagccgggttattcgtaaagatcgcgatgagccgtttgtttataacagcggcggttcctcttttgcttcgcgcccagtctggcgcagcacttctggtgattactcctggcgctccggttctggcaaaaaagagtcttactcttcgggcggctttaccaccaaaaaagcgtctaccgtttctcgcggcggctatggtcgttcttccagcgcccgtgggcattggggaggctaatcatgctgagacacaacgttcctgtgcgacgggatctggaccagatcgccgctgacaacggtttcgactttcatatcatcgacaatgaaatctattgggatgagagtcgggcttaccgttttactctgcgccagattgaagagcagatcgaaaaaccgactgcggaactgcatcagatgtgccttgaggtggtggatcgcgcggtaaaagatgaagagatcctgacgcaactggcgatcccgccgttgtactgggatgtgatcgctgaaagctggcgcgcccgcgatccttcgctgtatggacggatggattttgcctggtgtggcaatgcgccggtgaagctgctggagtacaacgccgatacgccaacttcattgtacgagtcggcttatttccagtggctgtggctggaggatgcccggcgcagcggcattattccgcgtgatgccgatcagtacaatgctattcaggaacgcctgatttcacgctttagcgagctttacagtcgggaaccgttttatttttgctgctgtcaggacaccgatgaagacaggagtaccgtgctgtacttgcaggactgcgcccagcaggcagggcaggagtcgcggtttatctacattgaagatctcggtttgggcgtcggcggcgtactgaccgatcttgatgataatgtcatccagcgtgcatttaagctgtatccgctggagtggatgatgcgtgacgataacggtccgctgctgcgcaagcgtcgcgagcaatgggtggagccgttatggaaaagtatcttgagtaataaagggctaatgccgctgctttggcgcttcttccctggtcatcctaatcttcttgcgtcctggttcgatggcgagaaaccgcagattgccgctggcgaaagctatgtgcgtaaaccaatctattcgcgcgaaggcggcaacgtcaccatttttgacggcaagaataacgttgttgaccacgctgatggtgattacgccgatgaaccgatgatctaccaggcgtttcaacctctgccgcggtttggcgatagctacacactcatcggtagctggattgtcgatgatgaagcgtgcggaatggggatccgtgaagataacacactgatcaccaaagacacctcacgtttcgttccgcattacattgctggataagaatgttttagcaatctctttctgtcatgaatccatggcagtgaccatactaatggtgactgccattgatggagggagacacagtgcactggcaaactcacaccgtttttaatcaacctataccattaaataacagcaacttatacctgtctgatggcgcgctctgcgaagcggtaacgcgtgaaggtgctggctgggatagcgattttctagccagtattggtcagcagttaggaacggctgaatcccttgaactggggcggctggcgaatgtgaatccgcctgaattattgcgctacgatgcgcaaggacgccgtctggacgatgtgcgttttcaccccgcctggcacctgctgatgcaggcgctatgtaccaatcgggtgcacaatcttgcctgggaagaagacgctcgctccggcgcatttgtggcgcgcgcggcgcgttttatgttacatgcgcaggttgaggcagggtcgttatgtccgataaccatgacctttgccgccacgccattgttgttacagatgttacccgcgccgtttcaggactggaccacgccgctattgagcgatcgctacgattctcacttattgccaggtgggcaaaaacgcggtttgttgattggcatgggaatgacggaaaagcagggcggttccgatgttatgagcaacaccacccgtgcagagcgtctggaagatggctcttatcggctggtggggcataaatggtttttctcggttccgcaaagcgatgcgcatctggtgctggcgcagaccgcgggtggtctgtcctgcttttttgtgccgcgctttttgcctgacgggcaacgcaacgcgattcgcctcgagcggctgaaagataagctgggtaatcgctctaacgccagttgcgaagtggagtttcaggatgccattggttggttgttggggctggaaggggaaggaattcgtctgatcctgaaaatgggtgggatgacgcgttttgattgcgccctgggtagccatgccatgatgcgccgtgcattttcgctggcgatttatcatgcacatcaacgccatgtttttggtaatccattgatccaacagccccttatgcgtcatgtcttaagtcgcatggcacttcagcttgaagggcaaacggcgttgctgtttcgtcttgcgcgagcgtgggaccggcgtgccgatgccaaagaagccctgtgggcgcgtttatttacgcctgcggcaaaatttgtgatctgcaaaagaggtatgccgtttgtggccgaagcgatggaggtgctgggcggcattggttattgcgaggagagtgagctgccgcggctttaccgggagatgccggtaaacagtatttgggaaggttccggcaatattatgtgcctggatgtgttgcgcgttctcaataagcaagcgggcgtatacgacttattgtcggaagcatttgtggaagtgaaagggcaggatcgctattttgatcgcgcggttcgtcgtttacagcagcagctgcgtaagccagctgaagaactggggcgagagattactcatcagctattcctgctgggctgcggtgcgcaaatgttgaaatatgcttctccgccaatggcgcaggcgtggtgtcaggtgatgttagatacgcgcggcggcgtacggttgtcagagcagatccagaatgatttattgctgcgggcgacggggggagtgtgtgtgtaagcgtatacgactgatgcgacgctggtttcgattaactaaatgaaatatgtgaaaattgtaggccggacaaggcgctcgcgccgcatccggcattgttcatttgctgtagatgacactcatgcatacagtatcgcctgtacgcgccagttatcaggctgctggtcttcgtacatggtaataatgcggtaccatgacgcaccttgttcatcggcctttaacgccacgatacgttccacgtcctgcggatcccctgaaatattgctaactgagatctgacctatttcattcaggcccgtcacgcagtcagcactggcgaattctgcagactgtgccgtggcgctcgcaggataagtcactaattgcagcgagggtgaggcaagtaattgtttcatcgtcagctccatttttcgtttccccacatgttgcagggcattccatcgcggtaataaacgcccaggcttccagccggtaatttattgtgcacaggtaaacgcatagggacgcaaagcaatgtaaagctgactatgtaagttgtctgatttatttacggtacaaaatggcttgtgaataccactgtcctgtcacgatggtttcgtccaccatgacgacaacgtaataatcagcttttgcagcgacagctttcgctttgatttctgctaatgcgtcatccggagaaccccgaaccatcgtgcttacgctacctattcgctgtaacccttgcgtctggtcgcggcgaatctcttgcggatggtccgttactggcggtgctggctgtggcgtaccttgcagtgcgctacaggcacttaacatcaacaccaataataaactggcaaaccggtaaataacgctattacgtttcctgctaaccatagtgtagtgccttattaatttaactttgggggaatgttcccgaattgttacctggtacgcgattttcgaatgaaaacgtgacgaaagcgtaacccacatctcaacattatgaactaataccgccagcagaaacttgtgctaaggatttcttcatgtcataccagacaaaaaggagagacagatgattgaaatagaatcacgcgagctggcagatattcccgttcttcatgcttatcctgtcgggcaaaaagataccccgttaccgtgcgtaattttttatcacggctttacttcatccagtctggtgtatagctattttgccgttgcgctggcgcaggctggtttgcgggtgatcatgccggatgcgcccgatcacggtagccgttttagtggtgacgcagcgcggcggttaaatcaattctggcaaatcttgctacaaagtatgcaggaattcactactttacgtgcggcaatagccgaagaaaactggctgcttgatgaccgtctggcagtcggtggcgcgtcgatgggcgcgatgacggcactggggattaccgctcgccaccccacggtgagatgtaccgccagcatgatgggatcgggctattttacatcactcgcccgttcactgtttccaccgctgatacctgaaacggcagcacagcagaatgaattcaataacattgtcgcgccactggcagagtgggaagcgacaaaccacctggaacaacttagtgacagacctctactgctgtggcatggcctcgacgatgacgttgtgcctgccgacgaatcactacgtttgcagcaggccttaagcgagacgggacgggataaactgctaacctgttcatggcagccaggcgtgcgtcaccgcattacgcctgaggcgttagatgctgccgtgacatttttccgccagcatctttaaacacgcagaatgctgaccccttgcgcttccagttgttgcaggatttccgggttagcatttttgccggtgataagcatatcgatttgatcggcacggctaaaaagcattcccgcgcgttcgccaatcttactgctatcaaccagtaccaccagtttccctaccacgctcagcatcttctgctctgccattgctgtcagcatatcggttttatacaacccttctgcggtcagcccttttccgctggtaaacatccagtgcccggcatagagactgttttcgctgccctgcgggcttaaagtgatggactgacttttgttgtactgtccgcccataatgatcacgctgtcatgttcttgatcgatcaggtaatttgccagcggtagataattagtgatgatttgcactggcttgccacacatttcccgcccaagcagaaacgcggtggagccgcagttgatgactacgctttcgcccggattaaccagctgcgaggccgctttagcgatacgtactttttcatcgtgattctgcgcctgatgcagattcatcggcgtccagcgcgggcgctgttgggtaatagcttctgcgccattgcgcacttttttcagtttgccgctttcgtcaagtttattgatatcgcgtcgcgcagtggcaggcgaaattcccagacgctcaacgactttctcaacggtcacaaagcccaattgtgcgagcatttccaggaggatttgatgtctttgtgcttcagtcatgagctattccgataaaatttgatttttttagatgatatttgaaatagccaggaaatactacgccggatagcgcgaacttctccacgctacccggtataaacgacagattacaggaatgacttgaacggcagatccggttcaatagtgaagcaatcatcgaaaccgcgcggatagtggtactcgaagttgtctttatccagcggccaggtaaatttgccacccacctgccagataaacggcttgaagccatacttcaggcgatcttttttcatctcccacagcacgcggatctcttgcggatcggcctggaagtttgaccagatatcgtggtggaacgggatcactactttcgcattcagcgcttcacccatacgcagcatatcggcgctggtcattttgtcggtgataccgcgcgggttttcgccgtacgatcctaacgccacgtcgatctgatgttcgttaccgtgcttcgcataatagttagagtagtgggagtcgccgctgtgatacagggagccgccaggcgttttgaacaggtagttcaccgcgcgatcgtccatgccatctggcagtacgccagccgctttttgatcggcaggcagggtgatcagtgcagtacggtcgaaagcatcaagcgcatgaatttcaatgtctttcacttttactacatcgcccggtttgaccacgatgcaacgctctttcggtacgccccagccaatccacaaatccacacaggttttcggtccgataaacggtacgtcatctgcacaattctgcatcacggcagcagcgacgttaacgtcgatatgatcgttgtgatcgtgagtcgccagtaccgcgtcgatctggcgaatcgcaaacggatcaagaacaaacggggtggtacgcaggtttggctgcagttttttcacgccagccatgcgctgcatctggtgaccctgtttcattaacgggttaccgtgactttgtttgccagtgccgcaccagaaatcaacgcaaacgttggtgccaccttccgatttcaaccagatcccggtgcagccaagccaccacatcgcaaatgtgccaggagcgacctgttcttgttcaatttcttcattcaaccagctaccccactccgggaaagtgctcaggatccaggattcacgggtgatacttttcactttactcatcgccatttaccttcatgatagttcaattcgaatcaatatgtgattggttttgattaatcctgacactattttttcaggaaggcaatgaccattttttgactttttgccagggaagttgttgttgattttgagtatggaaagatttaatggaatgtgtaattcaattaactaaatgaatttaaatggataattgtttcgttgtgtgaatcccactctatccatgtggaattatttgcgggtcgcgtcacatttaatcataaataatcttgttgtgattacttttgaaaattagagtgagtgcacaacattccgggtgtgtggaatacccggttacctcttcttcaggagatcgttatggagatcctctacaacatctttaccgtgttttttaaccaggtcatgaccaatgccccgttgttgctgggtattgtgacctgtctgggctacatcctactgcgcaaaagtgtcagcgttattattaaaggcacgattaaaaccataattggtttcatgttgttgcaggcagggtccggcatcctcaccagcaccttcaaaccggtggtggcgaaaatgtccgaagtctacggcattaacggcgcaatttccgatacctacgcttcaatgatggcaaccatcgaccgcatgggcgatgcctatagctgggtgggttacgccgtattgttagcgctggcgctgaacatctgttacgtgctgttgcgtcgcattaccggcattcgcacaatcatgttgaccggccacatcatgttccagcaggccgggttgattgccgttacgctgtttatcttcggctactccatgtggaccaccattatctgtaccgcgattctggtttcgctctactggggcatcacttccaacatgatgtacaagccgactcaggaagtgacggatggctgtggtttctccatcggtcaccagcagcagtttgcatcatggattgcctataaagtcgcgccgttcctcggcaaaaaagaggagagcgttgaagacctcaaattgccgggctggctgaacattttccacgacaacatcgtctccacggcgattgtgatgaccatcttctttggtgccattctgctctccttcggtatcgacaccgtgcaggcgatggcaggcaaagtgcactggacggtgtacatcctgcaaactggtttctcctttgcggtggcgatcttcatcatcacgcagggtgtgcgcatgtttgtggcggaactctctgaagcatttaacggcatttcccagcgcctgatcccaggtgcggttctggcgattgactgtgcagctatctatagcttcgcgccgaacgccgtggtctggggctttatgtggggcaccatcggtcagctgattgcggttggcatcctggtcgcctgcggctcctcgatcctgattattcctggctttatcccgatgttcttctctaacgccaccatcggcgtgttcgctaaccacttcggcggctggcgtgcggcgctgaagatttgtctggtgatggggatgatcgaaatctttggttgcgtctgggcggtgaaactcaccggtatgagtgcctggatgggcatggcggactggtcgattctggcaccgccgatgatgcaaggcttcttctccatcggtatcgcctttatggccgtcatcattgtaattgcactggcttatatgttcttcgctggccgcgcgctgcgcgcagaagaagatgcagaaaaacaactggcagaacagtctgcttaataaggagttttgattatgaccgtacgtattctggctgtgtgtggcaacggacaaggcagttccatgatcatgaagatgaaagtggaccagtttttaacccaatcaaacattgaccatacggtaaacagctgcgcggttggcgagtacaaaagcgagttgagtggcgcggatatcatcatcgcttctacgcacattgcgggcgaaatcaccgtgaccggcaacaaatacgtggttggcgtgcgcaacatgctctctcctgccgactttggcccgaaactgctggaagtgatcaaagagcatttcccgcaggatgtgaagtaaggacgcgccatgaaattacgtgattcgctggcggaaaataaatccatccgcctgcaggctgaagcagagacatggcaggaagcggtgaaaatcggcgttgacctgctggtggcggcagatgtggtagagccgcgttactaccaggcgattctggatggcgttgaacagttcggtccttatttcgttatcgctccgggcctggcaatgccgcacgggcgtccggaagagggcgttaagaaaaccggtttctctctggtaacgctgaaaaagccgctggagttcaaccacgatgacaacgatccggtggatatcctcatcaccatggcggcggtcgatgccaatactcaccaggaagtgggcatcatgcagatcgtcaacctgtttgaagatgaagagaattttgaccgtttacgcgcctgccgtaccgagcaggaagtactggatctcattgaccgcaccaacgcggcagcttaagaaggaattgaacatgtcattaccgatgttgcaagtcgcgctggacaaccagactatggatagcgcctacgaaaccactcgcctgattgccgaagaagtcgacattatcgaagtgggcaccattctgtgcgtgggcgaaggcgtgcgtgcggttcgtgacctgaaagcgctctacccgcacaaaatcgtactggcagacgccaaaattgccgatgcaggcaaaatcctttcgcgtatgtgcttcgaagccaacgctgactgggtgacggtaatttgctgtgcggatatcaacaccgccaaaggcgcgctggacgtggcaaaagagtttaacggcgacgtgcagatcgaactgaccggttactggacctgggaacaggcgcaacagtggcgcgatgcaggcattgggcaggtggtttatcaccgcagccgtgacgcgcaggccgcaggcgtggcgtggggcgaagcggacatcaccgcgatcaaacgtctttccgatatgggcttcaaagtcaccgtcaccggaggcctggcgctggaagatctgccgctgttcaagggtattccgattcacgtctttatcgcgggccgtagtatccgtgatgccgcttctccggtggaagccgcacgtcagttcaaacgttccatcgctgaactgtggggctaaggagcggatatgttgtccaaacaaatcccgcttggcatctatgaaaaagcgctccccgccggggagtgctggctggaacgcctgcaactggcaaaaacgttaggcttcgattttgtcgaaatgtcggtagatgaaactgacgatcgcctgtcgcgcctcaactggagccgcgagcagcgtctggcgctggtcaatgcgattgttgaaaccggcgtgcgcgtgccgtccatgtgcctttctgctcatcgtcgtttcccgctgggcagtgaagatgacgcggtgcgggcgcaggggctggagattatgcgtaaagctatccagttcgcccaggatgtcggtattcgcgtgatccagctggcgggctatgacgtttactatcaggaagccaataacgaaacgcgtcgtcgtttccgtgacggcctgaaagagagcgttgagatggcaagccgcgcgcaggtgacgctggcgatggagatcatggattatccgttgatgagctccatcagcaaggcgctgggatacgcgcactatctcaacaatccgtggttccagctctacccggatatcggcaacctgtcggcgtgggacaacgatgtgcagatggagttgcaggccggaatcgggcatatcgtcgcggtacatgtgaaagacaccaaacctggcgtcttcaaaaacgtgccgtttggcgaaggtgtagtggatttcgaacgttgtttcgaaacgctcaaacagagtggctattgcgggccgtacctgattgagatgtggagcgaaacggcggaagacccggcggcagaagtggcgaaagcgcgtgattgggtgaaagcgcgcatggcgaaagcgggcatggtggaggcggcataatgcaaaagctaaaacagcaggtatttgaagccaacatggagctgccgcgctacgggctggtgacctttacctggggcaacgtcagcgctatcgaccgcgaacgcgggctggtggtgatcaagcccagcggcgttgcctacgaaaccatgaaagcggccgatatggtggtggttgatatgagcggcaaggtggtggaaggggagtatcgcccatcttccgacactgcgacgcatctcgaactctaccgtcgttacccgtcgcttggtggcattgtccatacccactccactcatgccaccgcatgggcgcaggcggggctggcgatcccggcgttaggcaccacgcacgccgactacttctttggcgacattccgtgtacgcgcgggttaagcgaagaagaggtgcagggcgagtatgaactgaacaccggcaaagtgattatcgaaacgctgggcaacgccgagccgctgcatacgccgggaattgtggtgtatcagcacgggccgttcgcctgggggaaagatgctcacgatgcggtgcataacgcggtggtgatggaagaagtggcgaaaatggcgtggattgcccgcggcattaacccacaactcaatcacatcgacagcttcctgatgaataaacacttcatgcgtaaacacggtcctaacgcttattacgggcagaagtagaacacgcgctgcggaaatttccttcctcgggagataactggtctaattccgcagccgtttttcaaaaaaaagccccctgcgaagggggcaaagcaaactatggcaatgtttcgttggttatacctggtgctagcgataaatatccgcgctggcgtgcatattgccgttactccccggttcccgcatcagaattacgtggtagtacgttgcgccttgcgcatctgtttcttcatttaatgcctgacgtgcttcgctttcagtggcgaaattatgattgatataaatcacgcctaagctttgcacatcgtccatatttctggcctggtggttattaatttcaatggctgcccatgtatttgcacttagcaaaagcacagccagaagggctaaaacacgactgaacatagatacctcctcgacggctgactttgtgtgctctcctctgtgatgatcttctgatttaattttaatcaatgataaagaagttgatggtgaccatttctgatgcagttgttcaaaaaaacaccatgatgaagtgtgatgaacttcaaatcagcgtgttagaggttaattgcgaaaggggagatttatttcggctctgcccttgagtttagcgaggcatacaagtactataacgcgtcatttttcagccgacctttaacacgttccttgcctccccgggattcggctgacccagacaggaggctgaataatccgtaaggagcaattcgatgcgtcattacgaaatcgtttttatggtccatcctgaccagagcgaacaggttccgggcatgatcgagcgctacactgctgccatcactggtgcagaaggcaagatccaccgtctggaagactggggccgccgtcagctggcttacccgatcaacaaactgcacaaagcacactacgttctgatgaatgttgaagctccgcaggaagtgatcgatgagctggaaactaccttccgcttcaacgatgccgttatccgcagcatggttatgcgtaccaagcacgctgttaccgaagcatctccgatggttaaagcgaaagacgagcgccgtgagcgtcgcgatgatttcgcaaacgaaaccgctgatgatgctgaagctggggattctgaagagtaatttctgatgaccaaccgtctggtgttgtccggcaccgtgtgcagggctccccttcgaaaggtcagtccatcaggaattcctcactgccagttcgtgcttgagcatcgttctgtgcaggaggaagccggctttcaccggcaggcgtggtgtcaaatgcccgttattgttagcggacacgaaaaccaggccattactcacagtataacggtcggcagtcgcataaccgttcaggggttcatttcatgccacaaggcaaagaacggactgagcaaaatggttttgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtccctgctgccgtacactgatcgccatcagtaatcggtcacggtccattaatacgactttgagaggataaggtaatgcaagttattctgcttgataaagtagcaaacctgggtagcctgggtgatcaggtaaacgttaaagcgggctatgctcgtaacttcctggtaccgcagggtaaagctgttccagctaccaagaaaaacattgaattcttcgaagctcgtcgcgctgaactggaagctaaactggctgaagttctggcagctgctaatgctcgcgctgagaaaatcaatgcactggaaactgttaccatcgcgtctaaagctggcgacgaaggtaaactgttcggttccatcggtactcgcgacatcgctgacgctgtaactgcagctggcgttgaagtggctaagagcgaagttcgtctgccgaacggcgttctgcgtaccactggcgaacacgaagtgagcttccaggttcacagcgaagtattcgcgaaagtgatcgtaaacgtagtagctgaataattcgttattcaacgagacgtaaaaacgccgaccattggtcggcgttttgctttctatttttcgtcaggtattagtttcgcaagtagatccattcaccattctcttgtgtccataagtcaggatggtttgctggcgttagatacatacgagcgcaactgatgtctcgctcctgcggcactcgctcgaaacccaaacccgagtagattgcggctgaacttgataaggaacgcagaccaattttcaaatcatggggtaaatcagaatacgcgtttagcaatgcagcaatgatgaatccgagggcattagaaacgcctgtaacagtgcgaagttggtcgatataaagatcgattgttggtagttcagatgaccagcaattaggcatttgggcaggaagggttacaacgtatcctatcgtttggccggtatagtctggagtaccataaccaggtcccaaaaccacttcgtgtattgtgtatttactgttgggttcgaaggattcgacatcttgcaataaatatttcagttctgcggttaacctcgcacccgcgtaagctttattgtatttctgggcgtgaatattatctaatgtagcttcatggttccatccaaaagaattatcaccattcattgtgattccatcgtaagcattacacctcgtcgctaacttattgaatgcttgccagtctgagagatctagtttgtggatctcaacagtacgtctgccatcgcaattatgatctcttccacgatttgaaagtaatgtagcgcgtgcgtattgatgaaattttaattttactggtttgtcggtggacgaaaaacgagataaatatgcaggaaatgaataaatagtcgttggtaatgtcattgtaatgttacctgtttaatgtttttataaatatcgcagctgaatgttcacagaaaaaaatcgatattaataaaaataagtttgttttctgaagtggtgaaaatagcggatggtgaaagatattaatatcaaaaatcgctcattatggatataacgatgcacccggggagaaaatgacttccacgccttacaccgtacattcttgttgtgcggtatgtaattattctacgctgtcggtatcggtgtattcgttaatcagcaggttagccagccacaaaaagccattgagaaaattattgattttacatgggattattatattgctaatccttggtttttaaaaattgtgcatagtgaaaatcaaagtaaaggtgtgcattatgcaaaatcacagcgtctcttagaaattaaccatgcgcacttgcagttaatggaatccttattggatgaagggaagaaacacaatatttttaagccagatatcgacccattgcaggtgaatattaatattgctgcgcttggcggatattatttgatcaaccagcatacgcttggcctggtttatcacatcagtatggtttcaccccaggcactggaagccagacgtaaggtcatcaaagagacaatccttagctggcttttggttgacccttcatctaccgcgcacgaataaaactgccatccggctggcgggtgaacaggacctgttgattattccccgtatcaatggttaagcccgtcaccacgccgctggcgttctggcggattttcaccatctgcccgttttgcaaattactcagcggcttacccgcgccttctacctgcgccattgcatagacatcggtagcgggcagtccgtggtcgcggaacagctgcgccatcgttttaccgggttcgacacggtaagagcgccattgattatcaattccgctatctggctggaatggttgcgtttgggtagtttgcggctgctcttctggctggccttcctgtataggttctggagcgaccggagccacctgatcaggatcattttgtggggtaactaattgcgcccgcagctgttcttctgtcggcggttgtgattgcgactgaatatctaactgcgcttcacgcgtcaccaccggcgcgttgggcgtatcatcagatggaagcagaaatccgaccaccaatacaatggcggcaataatgatcccccgacgatgcatcggcggcagcgggtccatgaagcgaaaattgtccggcgcgtgccagactttctccagggttggttttagttcaaagcgcccgggcatggtttcctcctgctccgcgtcttgttcctcaatcatagcctatgaataagctaacgctatgatgtccgtggtaaacccgcctttattatattcatacgggatattgctattgtttctttttccctgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggtattgccgatgcgctggaaggcaaacatccggctgttccggttgatgtggtgcatcgcgcgctgcgtgaaatccacgagcgcgccgatgccgttcgtcgtcagcgtttccaggcgatggctgctgaaggtgtgaaatacctggaagaaaacgccaaaaaagaaggtgtgaatagcaccgaatctggcctgcaattccgcgtgatcaaccagggtgaaggcgcaattccggcacgtaccgaccgcgttcgtgttcattacaccggtaaactgatcgacggcaccgtgtttgacagctccgttgctcgtggtgaacccgctgaattcccggttaatggcgtgatccctggctggattgaagcactgactctgatgccggtaggttctaaatgggaactgactatcccgcaggaactggcatatggcgagcgcggcgcaggcgcatccatccctccgttcagcaccctggtgtttgaagtcgaactgctggaaatcctctaagcagcgcattctgttcccctcgaacgagaggggagcaggcattcagcaataaacccttcagtttgccaaacggcgctattttgtgttgcaaagaccccgtaagcgtgtatttttgtgagctgtttcgcgttatcaccgtgatatgacactcactttaaacataaaattaacattagatctaaatcttagtattcatcccgcgtattgttacctaatatcgatgagtcccgatacagattcgtcgtatcatagactgactaaaggccgtagagcctgaacaacacagacaggtacaggaagaaaaaaacatggtagatcaggtaaaagtcgttgccgatgatcaggctccggctgaacagtcgctacggcgcaatctcacaaaccgacatattcagcttattgccattggcggtgccattggtacggggttgtttatggggtctggcaaaacgattagccttgccgggccgtcgatcattttcgtttatatgatcattggttttatgctctttttcgtgatgcgggcaatgggggaattgctgctttcgaatctggaatacaaatcttttagtgacttcgcttccgatttactcgggccgtgggcaggatatttcaccggctggacttactggttctgctgggttgtaaccggtatggcagacgtggtggcgatcacggcttatgctcagttctggttccccgatctctccgactgggtcgcctcgctggcggtgatagtgctgctgctgacgctcaatctcgccaccgtgaaaatgttcggtgagatggagttctggtttgcgatgatcaaaatcgtcgccattgtgtcgctgattgtcgtcggcctggtcatggtggcgatgcactttcagtcaccgactggtgtggaagcgtcattcgcgcatttgtggaatgacggcggctggttcccgaaaggtttaagtggcttctttgccggattccagatagcggttttcgctttcgtggggattgagctggtaggtacaacagctgcggaaaccaaagatccagagaaatcactgccacgcgcgattaactccattccgatccgtatcattatgttctacgtcttcgcgctgattgtgattatgtccgtgacgccgtggagttcggtagtcccggagaaaagcccgtttgttgaactgttcgtgttggtagggctgcctgctgccgcaagcgtgatcaactttgtggtgctgacctctgcggcgtcttccgctaacagcggcgtcttctctaccagccgtatgctgtttggtctggcgcaggaaggtgtggcaccgaaagcgttcgctaaactttctaagcgcgcagtacccgcgaaagggctgacgttctcgtgtatctgtctgctcggcggcgtggtgatgttgtatgtgaatcctagtgtgattggcgcgttcacgatgattacaaccgtttccgcgattctgtttatgttcgtctggacgattatcctttgctcgtaccttgtgtatcgcaaacagcgtcctcatctacatgagaagtcgatctacaagatgccgctcggcaagctgatgtgctgggtatgtatggcgttctttgtgttcgtggtcgtgttgctgacactggaagatgacactcgccaggcgctgctggttaccccgctgtggtttatcgcgctggggttgggctggctgtttattggtaagaagcgggctgctgaactgcggaaataaccgcattatcatgctggatggcgcaatgccatccagcttttagatcactcacccgccagcgcgcgtgggaacagtacattgttttccagactgatgtgatccatcaggtcatcaatcagttcattaatgccgttatacatcgctttccaggtggtgcaggcttctggcggcggtgtgacgttattggtggtgtgtttaatcacttccagcagttcgcccgcttcatcgtgctcgctttccattacgctgattggccccattgcctggctgcccatgccttgtttgatcatcgggaagaggatctgctcttctttcatcatgtggctggaaagctcttcatgcagcatggtcaggtattttgtcagcccttttggcacgctcggtttgtcggcgtgaacgcgctcgactttagtcgcttgcagaatcagctccggcagttgctcgcggtgacgatcgtggtagcgcacgatgatatggtcgatgatttctgccagcggggcgctacgccagtctttctcaatcggttgttcagcgagctttgccagttcagcttcaatgacctcaacatccagttctttacgtgccgccgcgcgcgccagcgtctgcttaccgccacagcagtaatccatatcatatttacgaaacagagctgaagcgcgaggaatagagagcgccagttcacctaaaggttggtcgcgataagccatagctgatacctcattcttaataagataagatgtattttaaatgcatctttaaggcaaaagctataacccttacgtagcagaggcttatttaactcactgccagcgtgtcaactttctgagacagattcagttaaaggtttttctggttttgctctgaccgcgatgaccacgccaatcactaacagcgcgataccgctcagcgtcattagcggcggcatttgctggcggagtaaaaaggtgtacagcaaacctgccagcgtttcgaaaacaatcagcggcccgagaatcactgtcggtaatagctggctggcgacgttccagcagagtgcgccaacccatgagcaaagcacggctatcgcaaccatcagactaataaacaccagcggacgggggccaaagggtagggagaagtccggcgtttgcgtattcagccagtaacaagcgacgagatagccgataagtgaaaccggcagtgtgaccagcgcctgcgctgttgcccacatcatcggatgtttgtcgggattttcccgcagccagcgggcgttgcgcagggcataccacgcccagcagaccacggaaactaacgccagcacgatgccagaggtataacgtgcccagtcaaaatcggggagtccgtggtttaactcagcaatattcacacacgccaggccgatgccaatacaaatcagtgctggggcgagttttccccacgcgagtttgccgtcgcgctggctataaagcagattggcaaagacaggaatgaccaccggcagggtgccgataatcatcgtggaaacaggcgcgccagtacgttgaatggcactggcaaggcagaagtaatagatgaggttgcccatcatagtgagcatcaaggcggtaagccagtcgcgacgcgccaactgacgcagacgcacgcgtcccagccaggcaatgggcagcgcaattaaccctaacgccagataacgccccatcgactgcaacatcgccgggtattccggcacgatcaacggcccgacaaaaataagcccccacatcaaccctgctaacagggcgtacagcacgccgctaatcattactggcatccattgatctgtcagaagaaagttcaggaagcagacatgattgctcccggcatcccgtcattatcagagaggatgcgggaggatgccactttaattaactagttattaacattaaaaagatggcttacgctttcggctaacgttgtcgttgggtggccaatcaatttgctaagtgttttgctgtcatcaaacagaccgcctttcgatgcgccaacgtcagaatccgccagcatatccgccagtccgtcgggcagtccgacgcttttcagtgccgcggcgaaatcggcttcgctcagattttgataggtaacctgtttgccgctctgtttggtcagctctgccgctaactgtgtcaacgtccaggcactatcgcccgccagttcgtaaaccttgccttcgtgaccggcttcgctaatcacgcgtgccgcagctgccgcataatctgcccgcgttgctgaggcgattttgccatcgcccgccgcaccgataaatacgccgtgttccagtgctgccggggcgctggcgaggtagttttcgctgtaccagccgttgcgcagcagggtgtaaacgatgccagaatcagccagcattttctccgtctcgatgtgctcatcggcgaggccgagcggggaggtatctgcatgtagcaggctggtataagcgataaatttcacgccagccgcctttgcggcattaataacattacgatgctgcggggcacgttgacccacttcgctggaagagatcagcagtagtttttccactccctgaagtgcagatgtcagtgcggcttcatcgccgtagtcagcctgacgcacggtaatgccttgtgctgccagggcttgggcttttgccggattacgaacgatagccactatttggctggcaggaaccgttttcatcaaggattcaataacatagtgaccaagttggccagtggcaccagtaatagcgatcatgggaagtctccatcgttttgtcttgtgtttaaatacgctaacacctaaacttacttttagtaagtacgtacaaaaaggtaagtatgaaatgagtcaggttagcctgtcgcaacaactgaaagagggtaatctctttgcggaacagtgcccgtcgcgcgaggtgttgaaacacgtcaccagccgttggggggtgttgattctggtggcgctacgcgaaggtactcatcgctttagcgacctgcggcgcaaaatcggtggggtgagtgaaaagatgcttgcgcagtcgttacaggcgttagaacaggatggttttcttaaccgtatcgcgtatccggtggtgccgccgcatgtggaatatagcctcacgccgctgggcgagcaggtgagcgaaaaggttgctgcactggcggactggattgagttgaatttgcccgaggtgttggcggtgcgggatgaacgtgcggcataactgccggatgcgctgagcttatctggtctacggtgcatggcttgtagggcggataagatgcgccagcatcgcatccgccaataaatgccggatgcggttgatgatttataggccgaaaaagaagtgttttacttactcaaatccacctgataaatcgcaaacccgatatcatcggtcgcgactttattcatcggatactgccctttctctttaataaacgctgcggctttatctgacggagaggtttcgaaacggatatccagtttcttatcgccagctatcggtgctaaacgccagttgttatctgccgccgggtgaatttcccccgcacgtttcgactcatcagcaatccacgctgccagcaccgagcggttctcatccggtgaagcaaaagcgatatggctgtcgcccgtaccggcaaatttgccgccgtaagcgcgatagttattggtggcaaccaggaacatggcgttcggatcaatcggcttgccattaaaggtcaggttcttaatcctttccgcattggcattaatcatctggcactcgccgtcataacgggcgggctgggtaacatcaatctgataattcacaccatcaataacatcaaagttataagtgcggaaaccatcccagttgatgagtgactgtggtttcgtgctgttgggatcaatctggttaaactgtcccgcggagcactccagccactctttcacctctttaccgctggctttcaccacaatcagcgtattgggatagagataaagatcggcggcattacggaaggtcaactggcctttttccacctccacatagcttgccgggtcatttttgcgaccaccgactttaaacggtgcggcagctgaaagcaccggcagttttgccagatccggatcgccctgaatgtaatgctcgacatacgctttttgcgcgttgttcaccacctgcacggtcggatcgtcctgcaccagcgccagatagctatacatattgtcggcagatttaccgattggcttgctgacgaactggcgtgtggcatcgtgatcggctttgagtgtttctaccagcttgctgtcttccgccgcgagggattttttattagcgatgtcgtaaatcggtcgtgcttccgctttcgcctgcgtcacctgccatttaccgctgtcattactgagttgtaagtcgaccacaccaagatgatcgccccacatgcctggcattaccgccggaacaccattcagcgtgcctttggcgatatcagccccttcgatatcagcaaaatctttacctgggaaaacggcgtgagcatggccaaacataatggcgttaacgcccggaatttcactgaggtaataaactgagttttccgccatcactttatacggatcggcagatagcccggaatgtgccagaacgacaacaacatcggcacctttctcgcgcatttcaggcacgtatttgcgcacggtttcggtaatatcattcaccgtcactttcccggataaattagctttatcccagcccatgatttgtggtggcacgacgccaatatagccaatcttcagcgtctgtttttttccgtctttatcgaccacttcggtgtctttaattaaatacggtgtaaacattggctgtttggttctggcgtcaatgacgttggcatttacataagggaatttcgctcctgccagcgcatttttcaggtaatccagaccgtagttaaactcgtggttgccaagcgttccgacggtatagtccagcgtatttaatgccttatagaccgggtgaatatcacctgcttttaatcctttcgccgacatgtaatcggccagcggactcccctgaatcaaatcgccgttatcaaccagtacgctgtttttcacttcattgcgggcatcgttaatcaggcttgccgtacgtaccagtccgaatttttccgtggcggtgtctttgtaataatcgaaatccatcatgttgctatgcagatcagtggtttccatgatacgcagatcgaccgtcgctgcattcacactggcggcaatcagcgtggccaggagcgttgcgctaaacttaatcatcagggacatccttttatcatcgggaatacgaaagaaaagggagaataaacgtcttacttatagaacagtgaagaatgccacaattttacgctttgaaaatgatgacactatcacagttggcgcattcattaacgatagggtataagtaaaacaataagttaacaccgctcacagagacgaggtggagaaatgttagatcaagtatgccagcttgcacggaatgcaggcgatgccattatgcaggtctacgacgggacgaaaccgatggacgtcgtcagcaaagcggacaattctccggtaacggcagcggatattgccgctcacaccgttatcatggacggtttacgtacgctgacaccggatgttccggtcctttctgaagaagatcctcccggttgggaagtccgtcagcactggcagcgttactggctggtagacccgctggatggtactaaagagtttattaaacgtaatggcgaattcaccgttaacattgcgctcattgaccatggcaaaccgattttaggcgtggtgtatgcgccggtaatgaacgtaatgtacagcgcggcagaaggcaaagcgtggaaagaagagtgcggtgtgcgcaagcagattcaggtccgcgatgcgcgcccgccgctggtggtgatcagccgttcccatgcggatgcggagctgaaagagtatctgcaacagcttggcgaacatcagaccacgtccatcggctcttcgctgaaattctgcctggtggcggaaggacaggcgcagctgtacccgcgcttcggaccaacgaatatttgggacaccgccgctggacatgctgtagctgcagctgccggagcgcacgttcacgactggcagggtaaaccgctggattacactccgcgtgagtcgttcctgaatccggggttcagagtgtctatttactaaattcagatggcagaaacagtgtatttcctgattctgccatcctgatttctcccaacctaaaaagttataaataaaaagagattgtatttaaagtgcaaaaattcaattgctaataagttacattttaataatgagcgttttttgatagtttacttctatagtgagatatttaatggcgacataaagtaaccaaataaaataaggttgtcatatgttacccaggatcagacacaataattttattggtgcggtggagttatttgtaaagtcttcgtatacaaaaacacattcaaacaatttttttaacaacatccatcatgcatttaagaaaaaagattggatttcgaattatgatagcctgttaactttgagggagttctttcgttgcgcaactcagattgataaaagtggttatcaggtgctttcatcaaaaaatgaaactgttcacgccatggataagtttcttatcagtttcagccttaaagataacggtgccgaatatacaatgacattgcgaggtagtggatttgaatacgaagaaatacccataacaataaatgaatataactcattcatggatttcaaaaaccgtgaatttccgttagaacaaaacagacgattgtatgcctgggatattctacagaaaaaacagtctgacataccgaaaaggattaaaggttatattcaccaggcgattggtgacgtgtctttaggttatgccttattggaggatatagtaagcaaattaaaacggggtaaatttgaactccaaataccaggaggtggaattaaagaatgcgatggatggtatatttacgaaaaaataattgatgataattttgccatagtcatagaatctttgggctttgcgcttaaaatctatggaggggatgaacgttttcgtaatggttcctctgttgttttggaggatgaagattactctcttatttataattttctggttaatgcaggttgccaacaagtcgaattagccgaacaagtggatgcgatagtaagtgcgaatctggccgcagatagcgatattaccaaagaaaagatttgcgagaaatataaatcgaccattgaggcgtttaaaaaagagcaactagcgttaccagtattagttcggcgtaagaactcagagacttaattcccctatcccatagataacgataggggaaaattatttttgcagaatttatgttattgccattatttgagcaacttttgcagcaggtccatcacttgctgcacctcttccggtgtgagcgccccgtctttggcccattgcacgcgaccatccttatccagcaccactacagcggaactttcttcatccagctgccaggcaccgagcgcgacgccattgctatcgacaataaactgcgaccagggataaagctttttattactctccagactgctgcgcacaaacatccctgaacccggaatcgcgtcgtcggtgttaacaatggtggtggtctggtaacgatcgtgcggtaacttcgctgatttaatcgcttcaatcagcgtcgcgtttttctcttttgcagaggtgcgaccagcaatatgttgcagtactcgcacttttcccactaactgcgcgctgttccaggttttgtagctaaactgatctttatcaagcaccaactcgccccgatcggtaatgccaatcggcggcactcgctgaccggtttcgaactgatgtgcggaagccatcatcggcaacagcaggcaggtgagtgccagaatcttgcgtagggtcatggtgtttccttcttatgatatgcaggtgatccgaccacttgggtctgagttttaatcatatgtgctatttatcgaatttcccgcaagtgtgatgccagtttgcggtcaagcgcacaaatcatatgaaaaatgaatgcttatactgaagaccgcgcttcggtaaaaagataattctgaataattgtaacctttaggtaaaaaaagttatacgcggtggaaacattgcccggatagtctatagtcactaagcattaaaatttgcgcctcataatagttgggccgattgtggcaccgcacaggcgtaatactcagcaggagataacaatgaaaattttccaacggtacaacccacttcaggtggcgaagtacgtaaagatcctgttccgtggacggttatacatcaaggacgttggcgcttttgaattcgataagggtaagattcttatcccaaaagtgaaggataagctgcatttgtcagtgatgtccgaagttaaccgtcaggttatgcgtctgcaaacagagatggcttaaccaaagtgctatgcagtaaaaagtgctatgcagtaataagacggctcctgattcaggagccgttgatgtttctgggggttacgcgacgctttcttctttatctttagcgtcaggcagttttggcgaaagggcggtggccttgctgtcgatccgggtcaccagcagctggtcgatgcggtagttatcgatatccaccacttcaaatttgtagccggcgaatttcaccgaatcggtgcgtttcgggatcttacgcagcataaacatcataaagccgccgatggtttcgtagttgcccgactgcgggaactcgtcaatatccagcacgcgcatgacgtcgtcaattggggtgccgccgtcaatcagccatgagttctcatcacgggcgacaatctgctcttccagcccctgaccgaccagatcgcccatcagcgtggtcatcacgtcattgagggtgatgatccccaccaccagcgcgtactcgttcatgatcaccgcgaagtcttcacctgcggttttaaaactttccaacgcctctgaaagggttaacgtatccggcacaatcagcgtgttgcgaatttgtacgccgctgttcagtgccaggctttggttagccagcacgcggttcagcaggtctttagaatcgacataaccgatgatgtggtcaatatcttcattacagacgaggaacttagagtgcggatgttccgccaccttattcttcaggctttgctcatcttcgtggagatcaaaccaaatcacgttttcacgcggtgtcattgaagacggaacggtacgggattccagctcaaagacgttttcaatcagctcgtgttcctgtttacgtaacacgcccgccagcgcaccggcttccactaccgcgtagatgtcatcagaagtgatgtcatctttacgtaccattggcagtttgaaaatacggaagattatgttcgccaggccgttgaagaaccacaccagcggggtgcaaacgtacaggcagaagcgcatcgggttgatgatacgcaaagccacagcttctggcgcaatcataccgatgcgtttcggggttaaatccgcaaacaggataaacatgccagtcactaacgagaaagagagaataaagctcagttgctcagagagctctgccgacatatagcgggagaacaggctgtgaaaagctggagaaaatgccgcatcaccgacgataccgccgagaatcgccactgcgttcagaccgatttggaccacggtaaagaacatgccgggattttcctgcatattcagaacgcgttgggcatttatattgccttcatcagccagcagtttaagtttgattttgcgtgaggcggcaagcgagatctcggacatcgagaagaacgcacttacagcgatcaagcagagtatgactaaaatactgtttaacatatcttatccgacctttcaggccagatcctcggaaggggaagttgattaatttgtgtgaaatacacattgaaagccgattcgaagaaagtgaaccggcattttcagtggctagtatagcgtaaggtactgtaaagccgccagagggttaaaattcagacagctgaaaaatgcaaaactgcctgatacgctatgccgatcaggcctacgcagtccttgcaatatattgaatttggacgattttgtaggcctggtaagtcgtttacgccgcatcaggcatagacaaagagcactttatcaacaaactacatttgtacccgtaacgctatgcttccggcggcagacagacgccaattccgccaattccacagtaaccatacgggtttttatgcagatattgctggtggtcatcttcggcataataaaacggtgtggcgttagcgatttccgtggtgatgtgacgatcgtcatcggcggcaagcatcgccgcctgaaaacgttccagactggcgcgagctgcggcatcctgttctggggtcagcggataaatcgctgaacgatactgcgtgccgtggtcattgccctgacgcattccctgggcgggatcgtgattctcccaaaatacctgtagcaactgctcatagctgatgacggaaggatcgtaaacaatgcgtaccgcttcggcatgacccgtatcaccggagcacacttcccgataagtcggatttggcgtatagccgccggtatagcctgcggcggtgctgtaaacgccgggtaactgccagaacagacgctccacaccccagaaacaacccatcgcaaaaatggcaatctccattccgtcaggtacattggtcattgagtgaccgttgaccgcatgcagcgtggctacgggcatcggggtgttacgtccaggcagggcatcggcgggggaaaccagatgctttttatcaaataaactcatggtgtcgctctcccgaaaatcggtcattggggttaaggttgtaacaagaggcgtatttgcacacaataaccaccgtgaataggtctaaagtaaaacataagaaatatttggggtttagtctgctttttaatccatattactggatttttgttaagccgtttaacggcgttccaggggcaggaaaaaaggatattcaggagaaaatgtgcgctatatccgacagttatgctgtgtaagcttactctgcttaagcggatctgccgtcgccgcgaacgtccgtctacaggtcgaggggttatcgggacagctggaaaagaacgttcgtgcgcagctttctacgattgaaagtgatgaagtgacgccagaccgtcgctttcgcgcacgcgtcgatgatgccatccgcgaaggtctgaaagcgctgggttattaccagccgaccattgaatttgatctccgtccaccgccaaagaaagggcggcaggtattgatcgccaaagtcacgccaggcgtgccggtgttaattggcggcaccgatgtggtattgcgcggcggcgcgcggaccgataaagactatttgaaattgctcgatactcgcccggctattggcacggtactgaaccagggcgattatgaaaatttcaaaaagtccttaaccagcattgcgttgcgtaaaggttatttcgatagcgaatttaccaaagcgcagctgggcattgcgctcggcctgcataaagccttctgggatattgattataacagtggcgaacgttaccgctttgggcatgtgacctttgaaggatcacaaatccgcgatgaatacctgcaaaatctggtgccgtttaaagagggcgatgagtacgaatcgaaagatctggcagaactgaaccgccgactttctgctaccggctggtttaactcggtggtggtggctccacaatttgataaagcgcgcgaaacgaaagtattaccattgacgggcgtggtttcgccgcgaacagaaaacaccatcgaaaccggggtcggttactctacggacgtgggaccgcgcgtgaaagcgacgtggaaaaagccgtggatgaactcttatggtcacagtctgaccaccagtactagtatttccgcgccggaacagaccctcgacttcagctataaaatgccgctgctgaagaatccactggaacaatattatttggtgcagggcggttttaagcgcactgacctgaacgataccgaatctgactccactacgctggtggcttctcgctactgggatctctccagcggctggcagcgtgccattaacctgcgctggagtctcgaccactttactcagggtgaaattaccaataccacgatgctgttttatcctggggtgatgattagccgcacgcgttctcgtggtggcctgatgccaacctggggcgactcgcaacgctactctatcgactactccaacacggcctggggttcagatgtcgatttctccgttttccaggcgcagaacgtctggatccgcacactgtacgatcgccatcgttttgttacacgcggcacgctgggctggattgaaaccggtgatttcgacaaagtaccgccggatctgcgtttcttcgccgggggcgaccgcagtattcgtggctacaaatacaaatctatcgctccgaaatacgccaacggtgacctgaaaggggcctcgaagttgataaccggatcgctggaataccagtacaacgtgaccggaaaatggtggggcgcggtgtttgtcgatagtggcgaagcggtaagcgatattcgccgcagcgactttaaaaccggtaccggggtcggcgtgcgctgggaatcgccggtcgggccaatcaaactcgattttgccgtaccggtcgcggataaagacgaacacgggttacagttttacatcggtctggggccagaattatgagtttatggaaaaaaatcagcctcggcgtggttatcgttatcttactgttgctgggatcggtggcgtttctggtgggcaccaccagcggcctgcatctggtatttaaagcggcggatcgctgggtgccaggactggatattggcaaggtcaccggcggctggcgcgatctcaccttgtctgacgttcgttatgagcagccaggcgtggcggtaaaagcgggcaatctgcatctggctgtcgggcttgagtgcctgtggaacagcagtgtttgtattaatgatctggcgctgaaagacattcaggtcaacatcgacagtaaaaaaatgcctccttctgaacaggttgaagaagaggaagatagcggtccgctggatctctccacgccgtatcccatcaccctgacacgggtggcactggacaacgtcaacattaagattgatgacaccacggtatcggtgatggacttcacctccggcctgaactggcaggagaaaaccctgaccctgaaaccgacgtcgctgaaaggcctgctgattgctctgccgaaagtggcggaagtggcgcaggaagaagtggtcgaaccgaaaattgaaaatccgcagccggatgaaaagccgctcggcgaaacgctgaaagatctcttttctcgcccggtattgccggaaatgaccgacgtgcatttgccgcttaacctgaacattgaagagtttaagggcgagcagctgcgcgtgacgggcgacacggacatcaccgtgagcaccatgctgctgaaagtgagcagcattgacggcaatactaaactggacgccctggatatcgattccagtcaagggatcgtcaacgccagcggcacggcgcagctgtcagacaactggccggtggacatcactctcaacagtacactgaacgtggagccgttgaaaggtgaaaaagtgaagctgaaaatgggcggcgcgctgcgcgaacagctggagattggcgttaatctttccggtccggtggatatggatttacgcgcccagacgcgactggcggaagccggattgccgctcaacgtggaagtgaacagcaaacagctttactggccgttcactggtgagaagcagtatcaggcggatgatctgaaactgaaacttaccggcaaaatgaccgattacacgctctctatgcgtacggcagtgaagggacaggagatcccgcccgcgactattaccctcgacgccaaaggtaatgaacagcaggtcaatctcgacaaactcaccgtcgcggcgctggaagggaaaactgaactcaaggcgttgctcgactggcaacaggccattagttggcgcggtgagctaacgcttaacggcattaacaccgccaaagagttcccggactggccgtcgaaactcaatggcttgattaaaacccgcggtagcctgtacggcggcacctggcagatggacgtgccggagttgaagctgaccggtaacgttaaacagaacaaagtgaacgttgacggcacgctgaaaggcaacagttatatgcagtggatgatcccagggcttcatctggaactcgggccaaacagtgccgaagtgaaaggcgagctgggggtaaaagatctcaatcttgatgccaccatcaacgcgccggggctggataacgcgctgccggggcttggcggtacagcgaaagggctggtgaaagtacgcggcacggtggaagcgccacaactactggcagatatcaccgcgcgcggcctgcgctggcaggaactttccgtggcgcaggttcgcgtggaaggcgatatcaaatccaccgatcagatcgccgggaaactcgacgtacgcgttgagcaaatttcgcagccggatgtaaatatcaacctcgtcaccctgaatgccaaaggcagcgaaaagcagcacgagctacagttgcggattcagggggagcctgtctccgggcagcttaatctggcaggaagttttgatcgcaaagaagaacgctggaagggaactcttagcaatacccgcttccagacgccggttggcccgtggtcgctgacccgcgatattgcgctggattaccgcaataaggagcaaaaaatcagcatcgggccacactgctggcttaacccgaatgcggaactgtgcgtgccgcaaactatcgatgcgggggccgaagggcgtgcggtggtgaatctcaaccgcttcgacctcgccatgctgaaaccgtttatgccagaaaccactcaggccagcggtatcttcacgggtaaagcggacgttgcctgggacaccacgaaagaggggctgccgcagggcagtatcaccctttcggggcgtaacgtgcaggtaacgcaaaccgtcaacgatgcggcgctgcccgtggcgtttcagacactgaatctgacggcggaattgcgtaacaaccgtgccgaattgggctggaccatccgcctgaccaataacggccagtttgatggacaggtgcaggtgaccgatccgcaaggccgccgtaatcttggtggcaacgtcaatatccgtaacttcaaccttgcgatgataaaccccatctttacccgtggggaaaaagcagcggggatggtgagtgccaacttgcgtctgggtggtgatgtgcaaagcccgcagttgtttggtcagcttcaggttacgggtgtggatatcgatggcaactttatgccgtttgatatgcaaccgagccagcttgcggtcaactttaacggtatgcgctcgacgcttgccggtacagtacggacccagcagggtgaaatctacctgaacggtgatgccgactggagccaaattgaaaactggcgggcgcgggtaacggcgaaaggcagtaaagtgcggatcaccgtgccgccgatggtacgaatggatgtatcgccagatgttgtattcgaggctacaccaaacctgtttaccctcgatggtcgcgtggatgtcccttgggcgcgcatcgtggtgcacgatctgccggaaagcgcagtaggcgtctccagcgatgtggtgatgcttaacgataacctgcaaccggaagagccgaaaacggcgtcgattccgattaacagtaacctgattgtccacgttggcaacaatgtgcgcattgacgcctttggcctgaaagcgcggctgacgggcgatctcaatgtcgttcaggacaaacaagggctgggtctgaacgggcagatcaacatccctgaagggcgcttccatgcctatggtcaggatctgattgtgcgtaaaggtgagttactgttctctggtccgccagatcaaccgtatcttaatattgaagctattcgtaacccggatgctacagaagacgacgtaatcgccggagttcgcgtcactggtctggcggacgaaccgaaagcggagatcttctctgacccggcgatgtcgcaacaagctgccttgtcttatttgctacgtggacaagggctggagagcgatcagagcgacagtgcggcaatgacctcgatgctgattggtttgggggttgcgcaaagtggccagattgtgggtaaaatcggcgagacgtttggcgtaagcaatttagcgctcgacacccagggagtaggcgactcctcccaggtagtggtcagcggctatgtattgccaggtctgcaagtgaaatacggcgtgggtatatttgactctatagcaacactcacgttacgttatcgcctgatgcctaagctatatctggaagccgtgtctggtgtagaccaggcactggatttgctctatcagttcgagttttagcaatgcgaatatttgtctacggcagtttacgccacaaacaaggcaacagtcactggatgaccaatgcccagttactgggcgatttcagtatcgataactaccagttgtatagcctgggccactatccaggcgcagttccggggaacggaacggtacacggtgaagtttatcgtattgacaacgccacgctggccgaacttgatgccttgcgcaccaggggcggtgaatacgcgcgccagttgattcagacgccgtacgggagtgcatggatgtacgtttatcaacgacccgtcgatggattaaagctaattgaaagcggcgactggttagacagggataagtaaccatatgcatacgccaccttcgggtggcgttgttttttgcgagacgactcgcattctgttttgtaattccctcaccttttgcttttctctccgagccgctttccatatctattaacgcataaaaaactctgctggcattcacaaatgcgcaggggtaaaacgtttcctgtagcaccgtgagttatactttgtataacttaaggaggtgcagatgcgtattaccataaaaagatgggggaacagtgcaggtatggtcattcccaatatcgtaatgaaagaacttaacttacagccggggcagagcgtggaggcgcaagtgagcaacaatcaactgattctgacacccatctccaggcgctactcgcttgatgaactgctggcacagtgtgacatgaacgccgcggaacttagcgagcaggatgtctggggtaaatccacccctgcgggtgacgaaatatggtaaagaaaagtgaatttgaacggggagacattgtgctggttggctttgatccagcaagcggccatgaacagcaaggtgctggtcgacctgcgcttgtgctctccgttcaagcctttaatcaactgggaatgacgctggtggcccccattacgcagggcggaaattttgcccgttatgccggatttagcgttcctttacattgcgaagaaggcgatgtgcacggcgtggtgctggtgaatcaggtgcggatgatggatctacacgcccggctggcaaagcgtattggtctggctgcggatgaggtggtggaagaggcgttattacgcttgcaggcggtggtggaataaggtgtgtttatttatcgcgggcataaaaaaacccttactaaccgaagcccggcgttcagggttattacgccagaagaacttatttattctttgcgcgctcgaaggaggcaacgatttcagctttagcggcttctgcgttttcccaaccttcaactttcacccacttgcctttttcgaggtctttgtagtgctcgaagaagtgagcgatttgcgctttcagcagttcaggcagatcgttaacgtctttaatgtgatcgtattctttgctcagcttgctgtgcggaaccgcaaccagtttcgcatcttcaccggcttcgtcggtcattttcagaacgccaaccggacggcaacggatcacagaacccggctgcagcgggtacggagttgggaccagtacgtcaaccgggtcaccgtccagagacagggtgtggttgatgtaaccgtagttgcatggatagaacatcgcggtggacatgaagcggtcaacgaacagtgcgccgctctctttgtcgatttcgtatttgatcggatctgcgttagccgggatctcaataacaacgtagatgtcttccggcagatctttacccgcagggacgttgagtaagctcatgtctgtttcctttaaaaatatgtggcaaacaagtgccgagtattatagccaactcgcgccgaatgtcttcgcttgttttcgtcttcattttcctttttcaccagttttaagacggtatacagagcaggaaaatccataaccgtagccgcatttttcatagtgagatgaaagcgattacaaacttgtgattaacgttttatttacttttttgaagtgtgatgtaacgcaatctgttacataacgaattgtctatagttttttcgcgaacatcttttaaccaataataactaccccgacgaggacaaccctatgtggaaacgcttacttatagtctctgcagtctcggcagccatgtcgtctatggcgttggccgctccattaaccgttggattttcgcaggtcggatcggaatcaggctggcgtgccgcagaaaccaatgtggcgaaaagtgaagccgaaaagcgcggaatcacgttgaaaattgccgatggtcagcaaaagcaggaaaaccagattaaagcggtacgttccttcgttgcacaaggggtggatgcgatctttatcgctccggtggtcgcgacaggttgggaaccggtattaaaagaggcgaaagatgccgaaatcccggtattcttgctcgatcgttccattgatgtgaaagacaaatctctctatatgaccaccgtcactgccgacaacatcctcgaaggcaagttgattggtgactggctggtaaaagaagtgaatggcaaaccatgcaacgtggtggagctgcagggcaccgttggggccagcgtcgccattgaccgtaagaaaggctttgccgaagccattaagaatgcgccaaatatcaaaatcatccgctcgcagtcaggtgacttcacccgcagtaaaggcaaagaagtcatggagagctttatcaaagcggaaaacaacggcaaaaacatctgcatggtttacgcccataacgacgacatggtgattggtgcaattcaggcaattaaagaagcgggcctgaaaccgggcaaagatatcctcacgggttccattgacggtgtaccggacatctacaaagcgatgatggatggcgaagcgaacgccagtgttgaactgacgccgaatatggcaggtcccgccttcgacgcgctggagaaatacaaaaaagacggcaccatgcctgaaaagctgacgttaaccaaatccaccctttacctgcctgataccgcaaaagaagaattagagaagaagaaaaatatggggtattgagggttgctatgcctgatgccgattcgtaggccggataaggcgctcgcgccgcatccggcgatggtgcactgaagcctgatgcgacgcttaccgcgtcttatcatgcctactgggagcacgctttacaccgggggaaaccatgacgaccgaccaacaccaggagatcctccgcaccgaaggattaagtaaatttttccccggcgtcaaagcgttagacaacgttgatttcagcctgcgccgtggcgaaatcatggcgctgctcggtgaaaacggggcgggaaaatcaacgctaatcaaagcattaactggtgtataccacgccgatcgcggcaccatctggctggaaggccaggctatctcaccgaaaaataccgcccacgcgcaacaactcggcattggcaccgtctatcaggaagtcaacctgctacccaatatgtcggtcgctgataatctatttataggccgcgaacccaaacgcttcggccttctacgccgcaaagagatggaaaagcgcgccaccgaactgatggcatcttacggtttctccctcgacgtgcgcgaaccgctcaaccgcttttcagtcgcgatgcagcaaatcgtcgctatttgtcgggctatcgatctctctgccaaagtgctgatcctcgatgaacccaccgccagtctcgacacccaggaagtggagttactgtttgacctgatgcgtcagttgcgcgatcgcggcgtcagcctgatttttgtcactcactttctcgatcaggtctatcaggtcagcgatcggatcaccgtcttacgcaacggcagtttcgtaggctgtcgggaaacgtgcgagctaccgcagatcgaactggtaaaaatgatgctggggcgcgagctggatacccacgcgctacagcgtgccgggcgaacattgttgagcgacaaacccgttgccgcgttcaaaaattacggcaaaaaaggaacgatcgcaccgtttgatctcgaagtacgccccggcgagatcgtcggtctggctggattgctgggatcaggacgtaccgaaaccgccgaagtgatcttcggtatcaaacctgctgacagcggcacggcgttgatcaaaggcaaaccgcaaaacctgcgatcgccacatcaggcttcggtactgggcattggcttctgcccggaagacaggaaaaccgatggcatcatcgctgccgcctcggtgcgggaaaatatcatcctcgctctccaggcccagcgcggctggctacgtcccatttcccgcaaagaacagcaagagattgccgaacgctttatccgccagcttggcattcgcacaccttcaactgaacaaccgattgaatttctctccggcggcaatcagcaaaaagtgttgctttcacgttggctactgacccgaccgcaatttctgatcctcgatgagccaacccgcggcattgatgttggtgcccacgccgagatcatccgcctgattgaaacgctatgcgccgatggtctggcgctgctggtgatctcctccgaactggaagagctggtgggctatgccgatcgggtgattatcatgcgcgatcgcaaacaggtggcggagatcccgctggcagagctttccgttccggcgatcatgaacgccattgcggcgtaaggagaacagtgtgatgcctcaatctcttccggacaccactacgccaaaaaggcgctttcgctggccgacggggatgccgcagctggtagcactattgctggtgctgctggtcgatagcctggtagccccgcatttctggcaggtggtgcttcaggatgggcgtttgttcggtagccccatagacattcttaaccgtgcagctcccgttgcgttactggcgattggcatgacgctggtgatcgccaccggtgggattgatctctccgtaggggcggtgatggctatcgccggagccacaacggctgcgatgacggtcgcgggattcagcctgccgattgttttgttaagcgccctgggcaccggcatcctggcgggattgtggaacggcatactggtagcgatcctcaaaattcagccgtttgtcgccactctgatcctgatggtcgccgggcgcggcgtggcgcaactgatcaccgccgggcagatcgtcacgtttaactcgccggatctctcatggttcggcagtggatcgctgttgttcctgccaacgccggtcattatcgcggtgctgacgcttatcctgttctggctgttgacccgcaaaacggcgctggggatgtttatcgaagccgttggtatcaacattcgggcggcaaaaaatgccggggtaaacacgcgaatcatcgtcatgctcacttatgtgttgagcgggctgtgtgcggcgattgcgggcattatcgtggcggcggatattcgcggtgccgatgccaacaacgctgggttatggctggagctggacgccattctcgcggtggtgattggcggcggatcgctgatgggcgggcgctttaacctgctactttcggtggtgggggcgctgattattcaggggatgaacaccggaattttgctttcgggctttccgccagagatgaaccaggtggtgaaagcggtggtggtgctttgcgtgctgattgttcagtcgcaacgctttatcagtctgattaaaggagtacgtagccgtgataaaacgtaatttgccactgatgatcaccatcggcgtctttgtgttgggttatctttactgcctgacccagtttcccggttttgcttccacaagagtgatctgcaatatcctgaccgataatgcctttcttgggatcattgccgttggcatgacctttgtgatcctctcaggtgggatcgatctctccgtcggttcggtgatcgcctttactggcgtgtttctggcaaaagtgattggcgatttcggcctctcgccgctgctggcgtttccgctagtgctggtgatgggctgtgccttcggcgcatttatggggcttctgatcgacgccctgaagatcccggcatttatcattacgcttgcggggatgttctttttgcgcggcgtcagctatctcgtttcggaagagtcgattccgataaaccatcccatttatgacacgctctcaagccttgcgtggaaaatccctggcggcggtcgcttaagtgcgatgggactgctgatgttggcggtggtggttatcggcatattcctcgcgcatcgtacccgttttggtaatcaggtatacgccattggcggcaacgcaacgtcggcgaatctgatggggatttccactcgcagcaccactattcgcatttatatgctctccaccggactggcaacgctggcggggattgtcttctcgatttatacccaggccggatatgcgctggcgggcgtaggtgtggaactggatgctatcgcctcagtggtaattggcggtacgcttttgagcggtggcgttggaacggtattagggacgctttttggcgtggcgattcagggactgattcagacttacataaactttgatggcacgctgagttcctggtggacgaaaatcgccatcggtattttgttgtttatttttatagcattacagcgtggattaacggtgctgtgggagaatcgtcagagttcgccagtgacaagagtcaacattgcgcagcaataaaaacgcctctccgtgtggagaggcgcaggagattacgcgtccgggaactcacggataaagcgttcgacatcttcaaccatatggtcgttgccgacaaagaatgaacggcgctggtgcagggtttccgggatgatatccagaatacgctctttgccatcgctcgctttaccgcccgcttgttccgccaggaatgccatcgggttgcactcatacagcaaacgcagtttgccgtccgggtggctggcggtgcttgggtagagataaataccgcctttcagcaggttacggtggaaatccgcgaccagtgaaccgatataacgtgaggtataagggcggttggtggatttatcttcttcctggcagaatttaatgtacttcttcaccccgttcggaaacttaatgtagtttccttcgttgatggagtaggttttgcctttctccgggaagcgcatccgttcctggcacaggcagaaaacgccgagcgaaggatcgtaagtaaaggcgtgaacaccgcatccggtggtgtaaaccagcatggtagaggagccgtataccacgtaacctgccgcaacctgtttgttaccaggctggaggaaatcttcttccgttaccggcgtgccaacaggcgtaacgcggcggtagatggagaaaatggtaccgacagagacgttaacatcgatgttggacgagccatccagggggtccatcagcaccacgtattttgcgtgttcacagccttcaaagacgacaatctcatcttcttcttcagaggcaatgcccgcaacgatatcgcgtgctttcagtgcggctttcagtttttcattagcgaacaagtcgagtttctgctgaacctcgccctgcacgttctcagcaccgctggcacccaggatatcaaccagtcctgctttgttgatatcgcgatggataatcttggcgcccagttttattgccgacagcaaagcagtgagctcaccggtagcatgagaaaactcgtgctgcttttcgacaataaattcacctaacgttttcataaaactttccctgcaatgtttatggagtaaagcgaccgcaacaatcttaacaaataatctcaatgttgcgctcaggtgaatcgcgccagcaaattacggattatcctgaaatgcgtttctcacttgcccgacatatgcgtaaaatgagcggcagattaaaaaaggatagtgacgtatgcgcattcatattttaggaatttgtggcacatttatgggcggtctggcgatgctggcgcgccagttaggccatgaagtaacgggttcggacgccaatgtgtatccgccgatgagcaccttacttgagaagcaaggcattgagctgattcaggggtacgatgccagccagctcgagccgcagccggatctggtgattattggcaacgccatgacccgtggaaatccgtgtgtggaagcggtactggaaaaaaatatcccttatatgtcaggtccacagtggctgcacgattttgtgctgcgcgaccgctgggtgctggccgttgccggtacacacggcaaaaccaccaccgcgggaatggcgacctggattctggaacagtgtggttacaaaccgggctttgtaatcggcggtgtgccggggaactttgaggtttcggctcatctgggcgaaagcgacttctttgttatcgaagcggatgagtatgactgcgccttcttcgacaaacgctctaaatttgttcattactgcccgcgtacgctgatcctcaacaaccttgagttcgatcacgccgatatctttgacgacctgaaagcgatccagaaacagttccaccatctggtgcgtatcgttccggggcagggccgtattatctggccggaaaatgacatcaacctgaaacagaccatggcgatgggctgctggagcgagcaggagctggtgggtgagcagggtcactggcaggcgaaaaagctgaccaccgatgcttccgaatgggaagttttgctggatggcgaaaaagtgggcgaagtgaaatggtcgctggtaggcgaacataatatgcacaatggcctgatggcgattgcagcggctcgccatgttggtgtagcgccggcagatgccgctaacgcgctgggttcgtttattaatgctcgtcgccgtctggagttgcgtggtgaagcgaatggcgtcacggtatatgacgattttgcccatcacccgacggcgattctggcaacgctggcggcgctgcgtggcaaagttggtggtacggcgcgcattattgctgtgctggagccgcgctcgaataccatgaaaatggggatctgcaaagacgatctggcaccttcattaggtcgtgccgatgaagtcttcctgctgcaaccggcgcatattccgtggcaggtggcagaagtggcagaagcctgcgttcagcctgcacactggagtggcgatgtggatacgctggcagatatggtggtgaaaaccgctcagcctggcgaccatattctggtgatgagcaacggcggttttggtgggatccatcagaaactgctggatgggctggcgaagaaggcggaagccgcgcagtaattcggccttagccagatatagtatgcgtaggccggataaggcgttcacgccgcatccggcatttgagcatagtgcctgatgcgacgcttgatgcgtcttatcaggcctacaggtgcaccgtatccggcaaaccatactcacatcaacaacgaaaattacccttcgttctccgctaactcgcgcagatactggaaaatctggcgtgcggatttcggcggcttattcccttctttctctttcttcgcgttgcggatcagagtacgcagttgctgacgatcggcatcgggccacagatttaatacctcagcgatggcgtcatcaccttgatcgatcagacgatcgcgcaggttttccagtttatggaacagcaccacctgctggttgtgacggtttttcagcttatccagcgcctgacgaataggctctacgtcgcgctggcgcagcatcttaccgatgagctgcaactggcggcggcgaccttccatcttaatacgctgggcgagctcaatagccgcgcgcagatccgcatctaacgggatcttatccagcgcgtttttccccagatcaacaatttccgcgccaaggcgttttagctcctcggcatcacgtttaatttcacttttactgacccagataatttcatcgtcttcgtcttcgatgtcatcaccgggaacgtcgtcgagccagtcttcgggctgcttagtcatctcaggctccttaaaaaaagaggctaatgttaccagttaagatgcgcactgaaaaacggttctctgttagacttcagagaaactctctacattatggcacttgcaatgaaagtaatctctcaagttgaagcgcagcgcaagattctggaagaagcagtttccactgcgctggagttggcctcaggcaaatcggacggtgcggaagttgccgtcagcaagaccaccggcattagcgtaagcacgcgttatggtgaagtggagaatgttgaattcaatagcgatggcgcgctggggatcactgtttatcaccagaaccgcaaaggtagcgcatcatccaccgatttaagcccgcaggccattgcccgtactgtacaggcggcgctggatattgcccgttatacctcgccagatccctgtgccggcgtggcagacaaagagctgctggcctttgacgcaccagatctcgacttgttccaccctgcggaagtttccccggatgaagccattgaactggcggcccgcgcagaacaggcggcattgcaggcggacaaacgcatcaccaataccgaaggtggcagctttaacagccactacggtgtcaaagtttttggcaacagccacggcatgttgcagggttactgctcaacgcgtcattcgctctccagctgtgtaattgccgaagaaaatggcgatatggagcgtgattacgcctacaccattggtcgtgcgatgagcgatctgcaaacgccagagtgggttggggccgactgtgctcgccgtactttatcgcgtctgtcaccgcgtaaactctccaccatgaaagcgccagtcatttttgccaatgaagtggcaaccgggctttttgggcatctggtgggggcgatagcgggtggatcggtttatcgtaaatctaccttcctgctggattcgctgggtaaacaaattctgccggactggctgaccattgaagagcatccgcatctgctgaaagggctggcgtcgacgccattcgacagcgaaggtgtgcgcaccgagcgtcgcgatattattaaagatggcatcctgactcagtggctgctgaccagctactcggcgcggaaactggggctgaaaagcaccggacatgcgggcggtattcacaactggcggattgccggacaaggtctaagcttcgagcagatgctcaaagagatgggcaccgggctggtggtgacggaattgatgggccagggcgtgagtgccattaccggtgattattcccgtggtgcagcgggcttctgggtagagaatggcgaaattcagtatccggtgagcgaaatcaccatcgcaggtaatttaaaagatatgtggcgcaatattgtcaccgtcggtaacgatattgaaacacgcagtaatatacagtgtggttctgtgctgttgccggagatgaaaatcgccggacagtaaaaaaactggcgcgacctgccgcgctataaactaaaaaattacacaaaatcattcgcactgcatcgagacggaaagtgaatgagggccggggagcgtactcgcagtacgtgacccggtcgaatgagcgtagtcgtcgatgaggcagtgtgaaggatgaagtgtaaataaaaaaggaactattcttgcagtctcctcgttggtattcagttcggcgtcatttgctgctgatctcgaagacaatatggaaaccctcaacgacaatttaaaagtggtcgaaaaagccgataacgcggcgcaagtcaaagacgcgttaacgaagatgcgcgccgcagcgctggatgcgcaaaaagcaacgccgccgaagctcgaagataaatcaccggacagcccggaaatgaaagatttccgccacggtttcgacattctggtcggtcagattgacgacgcgctgaagctggcaaatgaaggtaaagtaaaagaagcgcaggctgctgcagagcaactgaaaacgacccgcaattcatatcacaagaagtatcgttaattcctcatttccctgttgcctgcactcaggtaacagggaacttatcatcgcaaatgatgcaccacctgattgctgctgccgcgccagatcagggaagggtcttttaaatcctgcacaaatttgccgtcgaccagcacgttaatcaaatcaacaacctgcatttgcgcagcgttgagttcgtcgagtttatagcctgtccacacccagatgtctttacccggacactcggcgcggatgcgttgtaccagtttcagaatatccggcacgttttgcggatgcagcggatcgccgccggagagggaaataccctggcgtttgatacgagtgtcattcagatcgttaatgatctggtcttccattgctttggtaaatggctgaccggaatttacccgccatgtgcttttgttatagcaaccggggcattcatgaacacacccggagacaaacagggtgcaacgagtgccggggccgttgacgatgtcgacaggatagtactgatgataattcattatttcgcctggcttatcagtccgcgtgtaggctgcatccggtaatcaatgcctgatgcgacgctgtcgcgtcttatcagacctggagcaattgccaaatgtaggccggataaggcgtttacgccgcatccggcatttgcttagctcagagtgaagattaacctatctgcccattccccaaatgtttaacgcggcgcttaacttcttcctgcttaccagcgttaaacggacgtgcatccgggctacctaaatatccgcacacgcggcgagttaccgacacacgggaggcgtcatggttaccacatttcgggcaagtgaagcctttgctggtgcactcgaactcaccggtaaagccacactcgtagcactcatcaatcggtgtattggtgccgtaatacggtacatgctgatagctgtaatcccagacatcttccagcgccttcaggttgtgctgaatgtttggatactcgccgtagcaaatgaaaccaccgttcgccagcggcgggtaaggcgcttcaaagtcgatcttgtcgtacgggttcaccttcttctccacatcgaggtggaaactgttggtgtagtaacctttatcggtcacgcccggcaccacgccaaactcagcagtatcgagacggcagaagcgatcgcacaggttttcactcggcgtgctgtagagactgaaaccataacccgtttcttctttccactgatccactgcctgacgcagacgttcaacaatggcgatacctttcgcgcgaagctgctcgttgtcgtaaacatgctcgccgccgaacagcgcgttaatggtttcgtggatgccgatgtaacccagcgaaatagacgcacgaccgtttttgaagatttcagaaacatcatcgtcagcattgagacgcacgccacaagcaccttccatatagaggatcggggccacgcgcgctttcacgccttcgagacgagcgatacgggtcatcagcgccttacgtgccagcaccagacgttcatccagcagcttccagaaggtggcttcatcgccttttgcttccagagcaatacgcggcaggttcaggctgatcacgccgaggttgttacgaccatcgtggatctgctcgccgttttcattttcccacacgccgaggaagctgcggcagcccatcggagttttaaacgaaccggtgactttcactacctgatcgtagttcaggatatccggatacatgcgcttgcttgcgcactccagcgccagctgtttgatgtcgtagttcggatcgccttttttatggttcaggccatcgcgaatcgcaaacaccagtttcgggaacaccgcagttttacggtttttaccgaggcctgcgatacggttacgcaggatcgattcctgaatcaggcgcgattcccagctggtgcccaggccaaaaccaaaggttacaaacggcgtctgaccgttggcggtgtgcagggtgtttacttcgtactccagtgactggaaggcatcgtagcactctttgatggttcgagagttagcgtagccttcggcgtccgggatgttccactcttctgcggtcttgcgatgtttgttgtagctggcagtgacaaacggtgccagcacttcatcgatacggttaatggtggtgccgccataaatatggctggcaacctgagcaataatctgcgcagttaccgcggttgccgtagagatcgacttcggcggttcaatctcggcgttccccattttaaagccctgggtcagcatgcctttcaggtcgatcaacatgcagttgaacatcgggaagaacggtgagtaatcgagatcgtgatagtgaatatcgccacgctcatgtgcctgcaccacgtcacgcggcagcaggtgctgacgtgcatagtgtttagccacgatcccggccagcaggtcgcgctgggttggaatcaccttgctgtctttgttggcgttttcgttgagtaacgaggcgttggtctgctcgaccagaccacggatctcctggttcaggcgaccgcgtttttcacgttcaatgtcgcgatcgtgacggtactcgatgtaagcacgagccagttgtttgtatggacctgacatcagctgattttcaactgcggtctggatctcattgatatccacctggttgcggccctgcatctgctcgctgacaaccgcggcaacagtggcgcaataatcggcatcatcgacttccgctgctttagctgcacgcagaatcgcttctttgatgcgctctgatttaaacggcactttgcagccgtctcgtttcatcacatgcggtgtcatgatcgctccatatttttaagaacaggttatccacagaaattgggaaaggcgttttccggttttttcgtttcgttttccggtgctttccgcaatcgccatccgcttatccacaacgccgcacctttttcgtggggagctgtagtagcaattatagtcgattaatacaacatattgggttgggacgcattttaaagtctatatatagtgctttgcatcaaggatgtttgagctttttttgatgtagctcaaagtaaaaagcagagcgtacggatgacgggcgctacagcgatatgtaaattttttaatgaatttgctggttgaaaaatcaacaaaaacaacatactgacagacaaaaccccggaatgaccggcattaccggggcttagggaagatttacttctgtaaccaccagacagcctcaaaaggccgtaaattcatggcacagggttgtggtgaggcttcttcgtagttatgcatcacaagctgccagttgccgcgcatttgccctgcctgccagggttggatctcacggctaaggttggcaatgaccagcaaggtttgccccttccattcacggcgatagcaccacaatacagggctgtttggcagcagatcctggtaattgccccatgtcaggatggcttcctgcttacgcagtgcgattaacttttggtaggtgtaaaacaccgaggaatcatcggccagcgcggcttctacgttgatttgttgatagttatcgcccaggccaatccacggttcgccagccgtaaacccggcattatcgccgttgctccattgcatgggcgtgcgactgttgtcacgggatttactggcgaggattgccaataactcgtcggcatcacgcccatcgttgcgcagctcggcaaacatattgaggctctctacgtcgcgatagtcagtaatgcgcgtgaaatgcgggttggtcatgccaatctcttcgccctggtagatatacggcgttccctgcatgccatgcagcaccatcgccagcatttttgccgcaggcacgcggtattcaccttcatcaccaaagcgagaaacaatgcgcggctgatcgtggttacaccagaacaaggcattccatgctacgttgtgcattccttgttgccagtggcggaacaatgttttcaacgccacaaagtcaggtttagccagcgtccatttttcaccaccgggataatcgaccttcaggtgatgaaaattaaaggtcatcgacaattcactgcctgtcagagccgcgtatcgctggcaatgctcaaggctggtggaggacatttcacctacggtcattaacccgcgtggcgtaaacacatcgcggttcatctcgtgcaaaaactcgtgtgctcgtggcccgtcggtgtagaagcgacgcccgtcgccgtccaggtcttcagggaaacgcgggtctttggagatcagattcaccacatccaggcgcaacccgtcgaccccacgatcggcccagaactcacagacttttttcagctctgcgcgtaccgctggattctcccagttgagatccgcctgttctggtgcaaagagatgcaaatagtactgttcgctttccgcatgccagcgccacgcactaccgccaaattttgaacgccagttgttcggtggcgtttctggttctccatcgcgccagatataaaactggcggtaagggctttctttgttcagcgcctcgcgaaaccaggcatgttgggtagaggtatggttaaacaccatatcgagaatgatacgaatcccgcgcgattttgcctgcgtcaccagttcgtcaaaatcgtccagcgtgccgtaggtgggatcaatcgccgtatagttcgctacgtcgtaaccgttatcgacctggggagagacataaaagggggttagccagatggcatcaacgcccagtttatgcagatagtccaggtgttggataacgccacgtaaatcgccggtaccgctacccgtggtgtcctgaaaactctttggataaatctggtagataacgccgttttgccaccagtggggaagatgagtcattacgttattcctgcgaatgcgagggggcgcaattgcgccccgaagaaaattaaacaatgtccagcgtgcccaggcggtatttccgctgatagataaacgaggtgagtacaatcgggatgatgatggcgatagccattgccagcgcaaacacctgccagtagctcggttgaatcgagagaattcccggcaggccgcctacgccgatgccattcgccataacgccgttcaggccgcatagcaatcctgccagaccagaaccaatcatcgcgcacagcatcgggaagcgatatttcaggttgatgccgtacattgcaggctcagtgaccccaagccaggcggagatagcggcaggcacggagatctcgcgttcattgtgcttgcggctggaaatgataatgcctatcacggcggagccctgagcgatattcgacagcgcaatcagcggccacactggcgtaccacccatgctttgaatcatctgcaaatcaatagcaagcgtggtctggtgtacaccggtgatcaccagcggggcgtacaggaagccaaacaatgctgcgccaatcggagcaaagctgccggtcatcaggtgacgtaccgcaaaggcaacgccatcgccaatcatgcgaccaaacggaccaatcagcgcatgggcgaggaacaccgcgaggatcagcgaacagacgggtaccaccaccagatagaggtaatccggcacgatgcgtttaaggcgagtttcaataacgcccagcgccagtccggctaacagtgccgggatcacctgcgcctgatagcctactttggcgatgctgaacatgccaaagtcccacacttccggcagctgctgcccgagcagataagcgttcatcagctgtggagaaaccagtgtcacgccaagcacgataccaaggatcggcgtgccgcccatttttttcaccgctgaccagcaaataccgaccggcaggtagaagaagatcgcttcaccgatcaaccacagaaaatcgtagatcgtttgcagggaagggtacatttgcgccagcgtctgaccgttgctcatgggcaaatcgccgatcacattgcgaaaaccgaggatcaaaccgccgctaatcaacgcgggcagcaacgggaagaagatcaccgcgaaatgagagatcaactgctcatgccatttcatattatgccgggcggctttttttacctgctctttatcaacctgcgcctgtccggttgacgcaatcagtgcttgatagtaatcacccacgttggtgccaatcaccacctgaaattgcccggcattggtgaaacagcctttcaccatagggagttgctcaatttctttcggtctggcattggccggttggttgaggacaaagcgtaggcgagtaatacagtggctcaccgtcgcaatattgccgcgcccgccgaccagttcaatcaaccgatcgatatccgtttggtttattttgctcatcataaagccccatggcagatgacatttttggttggctgcagaatatattgcgcggaaaaatttaaaaacgggaacgttcccgaaacgcagcgaagatcacaatttatcgttcaggaaacgatcaggacagggtggcggggatgatgatttgttgcggttcgctgcgcccggttacctgcgcgatcaactggcaagccgcctggcgtccagcttcggcgtaaccgggatctacggttacgatctccggatggaggaatttcattaacggcgtattaccgacgctcgccagttgcaaggtgtcgatgcgttgctcttgcaggtatttacttgcgccaagtgccagcgtgtcggttgcgcacagtaaggcggtagtttcaggcgtaatcacttttgcaacgttctcatagccttgcttcatagcaagccctggcagggcggcaacgggatgcagtttatgcgctttgcagaacgccaggtaggcttcgtgacgtcgcttaccggttgtcacgtcactgtgcggcacgccgagataactgatattacgatgcccctggtcatacagccgttgcatcaggattttgattgccccttcgtcgtcataacagaccgaagcaaagccttttgcgtcacgcgccagcagaaccagcgatgactgccagtgggctaacatttcttctgttatgccagtaaaaccgaacagcactacgccgtcgatattacgccgtttcagcactcccaaatgttcggcaactaattgcggggaaaactgactttccatcatgattgggtcgtaaccttgttcatagaacgctggcagcatggtttgaacggcgagattttctgacaacgaatccagacgggtaacaatgatggcgaccactttatcgctttgcccacgcatagcgcgcgcagagcgggaaggggaaaatccatgctgattcatcactgcttcaacacgctcgcgggtgagctggctcacgccgctttcgttattcagcacccgggaaactgtagatttccccacgccgcttaagcgcgcgatatctttgatggtcagccgattttgcatcctgttgtcctgtaacgtgttgtttaattatttgagcctaacgttacccgtgcattcagcaatgggtaaagtctggtttatcgttggtttagttgtcagcaggtattatatcgccatagatgctacgaatattattggattctccttattatttgcggcgcttttttcacttaccggaggttatatggaacctgatcccacgcctctccctcgacggagattaaaacttttccggtaagcccgtcttttcacggcgttaccggatgcgtaaggccgtgacgttttaacgtccctgctcagctttattaccttcaggtaaggcttcgccacgcctgaagacatttctgtactgtttcagacagtgcggagggactccttatgtttaaagaaatttttacccggctcattcgccatttaccttcccgtctggttcatcgtgatccattgcctggcgcgcagcagacagtgaatacggtggtcccgccgtccttaagtgcgcattgcctgaaaatggcggtgatgcccgaagaagaattgtggaaaacgttcgacacccatccggaagggttaaatcaggcggaagtggaatctgcccgcgaacaacatggtgaaaataaattacccgcacaacaaccgtcgccgtggtgggtacatttatgggtctgctatcgcaacccctttaatattttactcaccattctcggcgctatttcttacgccacggaagatttatttgctgcgggcgttatcgcgctaatggtcgctatttctacgttgctgaactttattcaggaagcacgttccactaaagcggcagatgccctgaaagcgatggtcagcaatactgcgacggtgctgcgcgtaattaacgacaaaggcgaaaatggctggctggagatcccgatcgaccagctggtgcccggcgatattataaaactggcggcgggagatatgatcccggcagatttacgtatcttgcaggcgcgggatctgttcgtcgctcaggcgtcgttaaccggtgagtctctgcccgtagaaaaagccgctaccactcgccagccggagcacagcaatccgctggagtgcgacacgctgtgttttatgggcaccaccgtggtgagcggcacggcacaagcaatggtgattgctacaggtgccaatacctggtttggtcaactggcggggcgtgttagtgagcaggaaagcgagccgaatgcctttcagcaagggatcagccgcgtcagtatgctgctgattcgctttatgctggtgatggcaccggtggtgctgttaatcaatggttacaccaaaggcgactggtgggaagcggcgctgtttgcgctttcggtcgcggtaggcctaacgccggaaatgttgccgatgattgttacctcgacgctggcgcgcggcgcagtaaagctgtcgaaacagaaagtgatcgtcaaacatctggatgctattcagaactttggcgcaatggatattctgtgcactgataaaaccggcaccctgacgcaggataaaattgtgctggagaatcataccgatatctccggtaaaaccagcgaacgcgtgctgcatagcgcgtggttgaacagtcattatcagaccggacttaaaaacctgctcgatacagcggtgctcgaaggtacggatgaagagtcagcgcgctcgctggccagtcgttggcaaaaaattgatgagattccgtttgatttcgagcgtcgccggatgtcggtggtagtggcagaaaataccgagcaccatcagctggtttgcaaaggtgcattgcaggaaatcctcaatgtgtgttcgcaggtgcgtcacaatggcgagattgtgccgctcgatgacatcatgctgcgtaagattaagcgggttactgatacgctgaatcgtcaggggctgcgcgtggttgcggtggcgacgaaatacctgccagcgcgtgaaggagattaccagcgggcggatgaatccgacctgatcctcgaaggatatattgcttttcttgatccgccaaaagagacaaccgctccggcactgaaggcattaaaagcgagtggaattaccgtaaaaatccttactggcgacagtgagttagttgcagcgaaagtgtgccatgaagtggggctggacgcgggagaggtggtcattggtagtgatattgaaacgctatctgacgacgaactggcaaatcttgcacagcgtaccacgctgtttgcccgcctgacgccgatgcataaagaacgcattgtgaccttactgaagcgcgaagggcatgtggttggctttatgggcgatggtattaatgatgcgcccgccttacgcgctgcggatatcggcatttctgtggacggcgcggtagatattgcccgtgaagcggctgatatcatcctgctggaaaaaagcctgatggtgctggaagagggggttattgagggacgtcgcactttcgccaacatgctgaaatacatcaaaatgacggcgagctctaacttcggtaatgtgttcagcgtgctggtagcgagtgctttcttgcccttcctgccgatgttgccgttacacttgcttattcagaacctgctgtacgatgtgtcacaggtggcgatcccgtttgataacgtcgacgacgagcaaattcaaaagccgcagcgttggaatccggcggatctggggcgctttatgatcttcttcggaccgatcagctcgatcttcgatattttgacgttttgcctgatgtggtgggtattccatgccaacacgccggaaacgcaaacgctgttccagtcgggatggtttgtggtgggcttactgtcgcaaacgctgattgtgcatatgatccgcacccgccgtgtgccgtttattcagagctgtgcatcgtggccgttaatgatcatgaccgtgatcgtgatgattgtcgggatcgcattgccgttttcaccgctggccagttatctgcaattacaggcgctgccgttaagctatttcccgtggctggttgcgattctggcagggtatatgacattaacccagttggtgaaagggttctatagccgtcgttacggctggcaataaagaataaactgggcacgatagccccgattcagattgtagacaaagtgagttttgttcatgccggatgcggcgtaaatgccttatccggccaacaaattcaataaattgcaggaatcacgtaggcctgataagcgtagcgcatcaggcgattttgcgtttgtcatcagacttaatccgggcatgatagcccggatttccatcaagattagcgacgaacagcgatcgcttcgatctcaatcttcacgtctttcggcagacgggcaacttcaacgcaagaacgtgccgggaaggtggcgttgtgttcggtgaagaaggcttcgtaagtggcgtttacggttgcgaagtcgttcagatcttttacaaacacggtagttttaacgatgtcgcccactttcaggccagcggcttcgacgatcgcttttacgttatccagcgactgacgtgcctgtgcagcgacgtctgccggtacttcgcccgttttcggatttaccgggatctgaccggaggtgatgatcatattgcccagatcaacgccctgtacgtaaggaccgatagctgccggtgcattttccgtcgcgatagttttgctcatgatttctcctttattacagcggtaaaaagtctggctcattatagggagccagacttttattaccaaccgcaattaattggccagcaccacattatgggaaaactctttttcacagtatttgcatttgagcgcgatatcattggcgcgttttcgcacggcaaagctggatgaaaccggttcggcatggctgatacagttgctgttcgggcagaccagcacattgtcgatgcgctccggcagacttgggcgcgatttacccaccacttcatagttgtcgatacggttaaccgtggcttgcggcgcatacaatgccagttgatctacttgatcttcactcaaaaaggtattttcgattttgatcagatctttgcggcccatctcgccagaaggcaggttcagaccaatggtgatgcgctgatccgtttcggtcagcttgaacagactcaacagcttaaaaccgatctgggcggggatatggtcaattaccgtgccgcgtttaatagcttcaacctgcaatttattatcgtgtgtcatctctatttccccttacagtaccagatcgcgattcagaaccagtgccagtaacgcctggcgagcgaaaatcccgttgcctgcctgctggaagtaccaggcgtgtggcgttttatcaacatccgtcgcaatctcatcaacacgcggcagcggatgcagcactttcatattggctttggcgttgtggagatcgctggcgcgaagaacaaactgcgctttcacgttggcgtactcggacgggtccagacgctctttttgcacgcgggtcatgtacaggatgtctacttccgccatcacttcttcaatagagctgtgcagactccatgcgatccctttttcatcgagcatatccagaatgtattgcggcattgccagcgcgtccggcgcgatgaagtaaaaacggttgccgtcgaacttcgctaacgcctgagtcagggagtgaacggtgcggccatatttcaggtcaccaaccattgcgacgtggagattgtccagacgcccctgggtttcctgaatagtgaataagtccagcaaggtttgcgtcggatgttggttggagccatcaccggcattcagtaccggtacattgccggaaaactcggtggccaggcgcgccgcaccttcctgcggatgacgcatcactatcgcatcgacgtaagtgctgataaccgaaatggtatcggccagcgtttcgccctttttacccagtgatgtattggcgctgtcggagaagcccaccacgctggcccccaggcggtgcatagatgtttcgaaagagaggcgggtacgggtagaggcttcgaagaaacagctggcaatgactttgtgcttcaacagctctggttgcgggtttgctttcagtttcgccgctgtcgccagcaccagattaaggtcatcgcgactaaggtcgtttatggaaatgatatgtttctgatatagcggattagccatcttttatctcctgacgcctgggcaaaaaaaagcccctcgattgaggggctgggaatgggtgatcaacgggaagaaaaacggcaggccagcgtcttttttcagacgcggtaagacaaaatgtcgaacacactgaaccatacatcctcccggcaaattgtccggcattatactcatcgtcagaagcggcgcaagcatttgatgcaatattttgtcagcgcaaacggtttatttgaattaaaagtcaaggtatatgcatttttatttgatgtgattctgcaggggaactgtccttcggtatcaataattgcagacattccctgctttttcctttttcactttcacgcaatcagatatgcattttattccattcatccgacttatagggcggagtgtgaaagcgaacggctaacactattgcttactgctcagggatgcgcgctatcactttaatttcaaaatcaaagcctgccagccatgtaacacccaccgccgtccagtttggataaggtggggcgctaaatatttcatttttcaccgtcatgatgtcttcaaattggttttctggatcggtatggaagctcgtaacatcaatgatatcgtcaaaagtgcatcccgcagctgccagggtcgcatgcaaattatcaaatgccagtctgacttgttgctgaaaatcgggttctggtgttccgtcctctcgacttcctacttgcccggaaacaaacagcaaatcgccggaacgaatagccgcagaataacgatgctcagcatatagtgaatgtcggccagcagggaaaacagcggttctttctaccatttggttatcctcaagatttacgacatgaacagaagatttctctttaccgggagccgcttttagcggacgacgtgagtaaacaaaacccagacatcatggataatggctgggcttaattgagcgtagtcggttatgcgccaaacgcgccatcaatggtatgcatcgcgccggtaacaaaactggcttctggccctgctaaccatgcgaccataccagcgacctcttccggttgcccatgtcttttgatagccatcaaactatgcaacatatcgcgcattggcccgttggcgggattagcgtcggtatcaattggccctggctggacgacgttaatggtgatcccacgcggtccaaaatcacgggccagcccgcgcgccatgccttgcagggcagatttgctggcggcataagcagccatgcctgcaacaggcatacgatcgccattcacggagccgatgattaagatgcgcccgccttcgggcatctgccgggcggcttcaacagaggcatgataaggagcatgaatattgattttgaaaaggcgatcaatatcgtcggcatttaattccagggcctcgccaaagacgccaatacctgcatttaccaccaggatatccaatgcgccgctcttacgaacgacatcaatgacagcgtctctgtcagcactatctgtgaatactgctgtcgctccagtctcttgtgccaggcgtttagcggcatctttcgaccccgcataggtgaatcgtacattggccccatcggtgacgaaacgacgtacgatagcggcaccgataccacgactgccaccgaggatgagaactgtcttacctgtaaaagcgcccataaggactccttgatttattatgtaacatgcattacaaaactgttttaactttctgtcaacaggttttgtaatggtcactaaaaaacaatctcgcgttccaggtcgtcccagacgtttcgctcctgagcaggcaatctctgcggcaaaagtgctttttcaccaaaaaggtttcgatgctgtcagtgttgctgaagttactgattatcttggtattaaccccccgagcctctacgcggcttttggcagtaaagctgggttatttagccgtgtactcaatgaatacgtcggtacggaagctattccgcttgccgatattcttcgtgatgatcgtccggtaggcgagtgcctggttgaggtattaaaagaagcggcgcgcagatatagccaaaacggcggctgcgctggctgtatggttcttgaaggtattcatagtcatgatccacaagcgcgtgatattgccgttcaatattatcacgccgcagaaacgaccatttatgactacatcgccaggcggcatccacaacgcgcacaatgtgtgactgattttatgagtaccgtgatgtctgggctttctgcgaaggcacgagaggggcactctatagaacaactctgtgcaacagctgcaatggcgggggaagcgataaaaactattcttgaggagtgatgcgggccttgacccgaaaggcgggaaagcgcctgccgataagttgtgataagacaataattcacgcgttaaggctagcggaattgattatcttttcgtataacgatagaaatgaaacgttgttttaattaaggagtggaaaagatgatcatcggaaatattcataatcttcagccgtggctaccccaggagttacgccaggcgattgagcatatcaaagcacacgttacggcagaaacgccaaagggcaagcacgatatcgaaggcaatcgactgttttatcttatctcggaagatatgaccgagccgtacgaagctcgccgtgcggagtaccatgcccgctatcttgacattcagattgtgttaaaaggtcaggaaggcatgaccttcagcacgcaacctgcaggcgcgccggataccgactggttagctgataaagacatcgcatttttgccggaaggcgttgatgagaaaacagttattctaaatgaaggtgattttgttgtgttttatccgggggaagtgcataaaccgctgtgcgcagtgggcgcgccagcccaggttcgcaaagcagtagtgaagatgctgatggcgtgatgacttttcgccgtaaataactcaaggtttacggcgagtttgtgaaaagagcgttttttgatatttttttgtgagtaaaatttgtaatgcttagacgttcttattcactcaaggagttcgtcatgagcaaaatatcagatttaaattattctcaacacattacattagccgacaattttaaacaaaaaagtgaagttttaaatacctggcgtgttggaatgaatgattttgcccgtattgccggggggcaggataacagaaggaatattctttctcctggagcatttttagagtttttggcaaagatatttaccctgggttatgtggattttagcaaacgctccaacgaagcgggtagaaatatgatggctcatattaagtcctcatcttattctaaagatactaatggcaatgaaaaaatgaagttttacatgaataatcctgtaggggaacgagcggattcacccaaggtgattatagaaatttcactttccactatcactactatggggactcgtcaaggacatacagccattatatttccacaacctgatggttcgactaaccgttatgaagggaagtcctttgaaagaaaagatgagagttcattacacctgattactaacaaggttctggcgtgttaccaaagtgaagctaacaagaaaatagcgcgtctattaaataataatcaggagttaaataatctacagaaattaaataatctacagaagttaaataatctactgaagttaaataatatacaggggttaaataatcctcaggagttaaataatccgcagaatttaaatgattctcaggagttaaataactcgcaggaattaaatagtccacaggagttaaatgatccgcaggagttaaataattctcaggacttaaataactctaaggtgagttgtacagtttcagttgattctacgattacgggtttattaaaagaaccattgaataatgcattattagcaataaggaacgaacatctgctattaatgcctcatgtatgtgatgaatcgatttcatacttactgggcgaaaaaggtatacttgaagaaatagataagctctacgcattaaatgatcacggaattgataatgacaaagtaggtaacaatgaaattaatgacatcaaagttaacctgtctcatattcttattgattccttagatgatgcaaaggttaaccttacaccggtcatcgattcgattctggagactttttcaaaatccccatatattaatgatgtaagaatactggattggtgttttaataaaagcatgcaatattttgatgatactaaaaagataaagcatgcatgctccgtaataaatcatattaatcttcgcagcgatcagtctaaaatagctgagacattatttttcaatctcgataaagaaccctataaaaatagccctgaattacaggggttgatttggaataagttggttgtatatgtcaatgaatttaacttaagtaatcgagaaaaaacaaatttaatacaaaggctatttgataatgttgagtctatatttaatgaagtacctgtcagcattttagtgaatgatatttttatgaatgatttctttatgaaaaatcctgagatgattaattggtacttccctcagttacttaagagttatgagggtgaaaagatttattttgataatttaaaatatgatttaaatgataatgataaggaatctaataaagaaattttgaagaatcaaccagataatgttatcaaagaaaaactgaataatgaatacaaacttagatttagaatgatgcaaactatcttgcaatcgagagttaatgtattaccatatattaatgaacagcgtttaaataaactaaatccaccggaaaatttacgtatagcaatagaacactttgggtggaagaatagacctatcactgcataaaataatgtgatgccgggatggtttgtatttcccggcatctttatagcgatagcaattatttactgagcgtcgcgaccatcaccgctttgatagtatgcatacggttttccgcctgatcaaaaacaatgctggcggcagattcgaagacctcatcagtgacttccataccgccatgtaggccaaattcttccgccattttcttgccaagcgtcgtttggtcgtcatgaaacgcgggcaggcagtggaggaatttgacctccgggttaccggtcaactgcatcatcttgctgttcacctgatattcacgcagcaatgcaatccgttccgcccatttctcttttgcttcccccatcgacacccacacatcggtatagataaagtcagcaccttcaactcccttcgcgacatcttcagtcagcgtaatattcccaccattttgctgtgccagggcgcggcattccgtaaccagcgcagcttccggccagcacgcttgtggcgcgaccagacgcaaatccagaccggtaagcgccgcagcttcgagcatcgaattgcccatgttgttacgcgcgtcacctgcatagaccagcgtcatttcgttgaacgctttgccgggcaaatgctcctgcatggtgagaagatccgccagcagctgcgtgggatggaactcattggtcaggccattccataccggcacgctagcgtattccgccagtgtttcgacaatctcctgaccatagccgcgatactgaataccgtcatacatgcgaccaagcacgcgggcagtgtctttaatcgactctttatgaccaatctggctgccgcttgggccgagataagtaacgcgagcaccctggtcatatgcggcaacttcgaaagagcatcgggtacgagtcgagtctttttcgaagatgagcgcgatgtttttaccagtgagtttggcttcttctttaccgcttttcttatcggctttcagcttcgcggctaactgcagcaggctgttgagttcagctggcgtgaaatcgagtaatttcaggaaatgcttatgataaaacccggacatagatccctcctgtggctaacgcctcaatgaattaaaattcaatttatatggatgattattcatttgcaagtctaaagcataaatctttgtcacaaaggtggaggcaatgtcagtggtgtgtgacaataagagtatcggcaggacattaagaggaatgagccatggcaaacccggaacaactggaagaacagcgtgaagaaacacgtttgattattgaagaattactggaagatggcagcgatccggacgcgctgtacaccatcgaacaccatctttccgcagacgatctggaaaccctggaaaaagcagcagttgaagcgtttaaactcggttacgaagtgaccgatccagaagagctggaagttgaagatggtgatatcgtgatttgctgcgacatcctcagcgagtgcgcgttgaatgccgatctgatcgatgcccaggttgaacaactgatgacgctggcagagaaatttgacgttgagtacgacggatggggcacttactttgaagatcctaacggcgaagatggcgacgatgaagattttgtcgatgaagacgatgacggagttcgccactaattaagcgtagcgcatcaggcccaggtagttcctgcaacctggtgaatttgtagcccggataaggcattcatgtcacatccggcataaacaaaacgtacgttgttaatgttcgaatgcccgcgagttgaacacgcgggcatttttttagagttcgcgcaacatccgcacttcacaatcgacatggcccgtgcagccaagcgcatagtcgatatgctcaaagcccaaatgctcataaagcgcaatggcttcctttaaaaaagcggtcgtttccagatagcagcgtttgaaacccatctctcgcgcctgctccatcgccattaaggccagtttttttgccagccctttgccgcggatagccggaagaaaatacatcttttgcagttcgcaaatatccgactcactcccggttaatggcgctatcccaccgccgccgaccacttcaccctcgtactcaacgacccaatatgcatggccaggctgactatatacttgatacagctcgtcaagattcggatcggcgacggtgtagcctttatcagcggtaagaccgtattcggcggatacctgacgaatgacgcgggcgatagcaggattatcctgcagcgtcaggcgacgcattacaggtgattgcggcgcaatgttattcatagtttaacccaataaaaataaagtaattatacatttgtttaataccactctcttcttacgtacgcaagcgacttataaagtaataaagtttttgccagcctattactgataagagtattgtaacgtggcagaacattttactgtctgtatatataagttatatcaatggattttttaattcagggaatttttatggctcaagttattaatgaaatggatgttccgtcccattcgtttgtttttcatggtacaggtgagagatattttcttatttgtgtggtgaatgtgttgttaacgattataacgctaggtatctatttaccatgggcattaatgaaatgtaagcgttatctttatgctaatatggaagttaacggacaacgattttcttatggaattaccggtgggaatgtttttgttagttgtcttttttttgtttttttctatttcgcaatcttaatgacagtgtcagcagatatgccgcttgttggttgtgttttgactttgttactgttggttttgcttatatttatggcagcaaaaggactgcgtcatcaggccttaatgaccagtctcaacggcgtaagatttagttttaattgctctatgaaagggttctggtgggtgacctttttcttgccgattttaatggccattgggatggggactgttttctttatctcgacaaagatgctacctgccaatagttcaagtagtgttattatatccatggttctgatggcaatagttggtattgtttccattggtatttttaatggtactttatatagtctggtaatgagttttctctggagtaataccagtttcggtatacatcgtttcaaggtgaaattagatactacgtattgtataaaatatgccattctcgcatttttagctttattgccttttctcgctgttgctggttatattatcttcgatcaaatattaaatgcgtatgatagttctgtatatgcaaatgatgacattgagaatttacagcaatttatggaaatgcaacgtaaaatgataatcgcgcagttaatctattattttgggattgctgttagcacaagttatttaacggtgtctttgcgaaaccattttatgagcaacctgtcactgaatgatgggcgtattcgttttcgcttaactttaacgtaccacggtatgctttatcgcatgtgtgcgttggtggtgatatccgggattacgggcggtctggcttatccactgctgaaaatatggatgattgactggcaggcaaaaaatacgtatttgctgggcgatttggatgaccttcctttaatcaataaagaagaacaaccagataaaggcttcttagccagtatttcacggggagttatgccttctttaccatttctgtaagagataaaaaaggccggagcatgctccggccttcgttttcatcactgtgttttgattacagcgcggcgataacagcctgctgttcaatcagtttcgctttcgcttccgcatagccttccagcttctcacgctctttcgcgatgaccgcttccggtgcgcgggcgacaaagccttcgttcgccagtttgttctcgatacggctgatttcaccttcaatcttcgccacttctttcgccagacgcgccagctcatcttctttgttgatgaggccagccatcgggatcagcagctctgcaccgtcgatgatcttcgtaacggaaaccggacctttgtcatcggcaggcagcacggtgatactttccagacgcgccagggtttgcaggaagccacggttttcatttacgcgacgttctgcatccgcgctgcaaccacgcagcagcagctccagcggtttgcccggcgcgatgttcatttctgcacggatgttacgtaccgcaacgatcgcctgtttcagccattcggtgtcggccagtgcggcttcatcaacctgagatgcatcgtactgcgggaacggctgcagcatgatggtgtcggcagtgataccgcaaagtactttcacacgctgccagatggtttcggtgatgaacggaatgatcggatgcgcgaggcgcagcagaccttccagtacagtcaccagcgtatggcgagtaccgcgcagttctgcttcggtgccaccgttcattaccggcttggtcagctcgagataccagtcacagaactggttccaggtgaactcatacagaatgcctgcggcgatatcgaagcggaagctgtccagcgcttcgcggtacgctttgatggtctggttgaactccgccagaatccagcggtccgccagcgacagcgtcatttcgccgccgttgaagccgcaatcctgaccttctgtgttcatcagcacaaagcggctggcgttccacagcttgttacagaagttacggtaaccttccagacgcttcatatcccagttgatgtcacgaccggtagacgccagcgccgccagggtgaagcgcagcgcgtcagtaccgtgcggctcaataccgttcgggaactgcttctcggtgcgcttacggattttgtccgccagctgcggctgcatcatattgccggtacgtttttccagcagttctggcagcgaaataccgtcaaccatatccagtgggtcgataacgttacccttggatttggacatcttctggccttcgtcatcacgaatcaggccggtcatgtaaacggtgtggaacggcacctgcggtttgccattttcatctttgatgaagtgcatggtcatcatgatcatgcgggcaatccagaagaaaatgatgtcgaaaccagataccatcacgctggttgggtggaactgacgcagggcgtcggtattttccggccagccaagggtagagaaggtccacagcgcagaagagaaccaggtatcgagaacgtcttcgtcctgacgcaggacaacatcagcaccgaggttattttctttacgcacttcgtcttcgttgcggccaacataaacgttacccgcttcgtcataccatgccgggatacggtgaccccaccacaactgacgagagatacaccagtcctgaatatcgcgcatccaggagaagtacatgttttcgtactgcttcggtacgaactgaatgtcgccgttctcaaccgcttcaaccgccggtttcgccaggacatcggcacgcacgtaccactggtcggtcagcattggttcgataactacgccgccacggtcgccgtaaggaacggtcaggtcgtgcggtttaatttcttccagcaggccaagcgcgtcaactgcggcaacgactgctttacgtgcagcaaaacgctccagtttctggaactctgcagggatttcgctggaataaacgtcagattcgttacctttggtatcgaacacctgggcgctttcacggatatcgccgtcaaaggtcaggatgttgatcatcggcagggcgtgacgtttacccacttcatagtcgttaaagtcgtgcgccggagtgattttcacgcagccggtgcctttttccatgtcggcgtgttcgtcgccaacgatcggaatacgacggttaaccagcggcagaatgacatatttgccaatcagatctttgtaacgcggatcttccgggttaacggctacgccagtatcgcccagcagggtttctggacgggtagtcgcgaccaccagataatctttaccgtctgcggttttcgcaccgtcagccagcggatagcggatgtgccacatcgaacctttcgattcgcggttttcgacttccaggtcagagatagcggtgcgcagtttcggatcccagtttaccaggcgtttgccacggtaaatcaggtcttctttatacagacgaacgaaaacttctttcaccgcattggacaggccttcgtccatggtgaagcgttcacgctcccagtcgacggagttgccgagacggcgcatctgacgggtaatggtgccgccagattccgctttccattcccagattttgtcgatgaaagcttcgcggccgtagtcgtgacgggttttaccttcttctgcggcaatcttgcgctcaacgaccatctgggtagcgatcccggcgtggtcagtaccgacctgccacagggtgtttttgccctgcatgcgctgatagcggatcatggtatccatgatggtttgctggaaggcgtgacccatatgcaaactgccggtgacgttcggcggcgggatcatgatgcagaaactttcctggctttcatcgccattaggcttaaagtagccctgcttttcccagtgctcgtaaagcggctgttcgatatcttgtgggttatatgtcttttccattatttccaggttgccgtattcaggttgaaaccagccacgcggtaggctttatagcgttcgcgcgccagttgtttcagagaatcttcataaggaacgaagtctaccacttctgtgaaagcggtggcaaaatctgcaaagcttgttcgcagactaatcaatatatcgcgccggctgctgctacgcttttgcggccaggcgatctccaccggtgcaccgccgcgcggtccttctcccgctaaattatgcggaacaaagctttctgccggacgcgcccacagggcttcatccagccggtaagcctgcttttcatcttcacaggcgatgagcacgcgcttaccgctgcgccaacgttctgcggcaatttcacacaccagttgctcaacggcgcttaagccatcgacggtggtgtcattgtccagaaggtagaacgtcgcgtttttcataaatggggcttcttgtggtggatttaaatacgcatcaggtatacaccgcagcgcctgatgcgacgctgttgtgtcttatcaggcctacgagttcagtgctgtgtaggtcggataaggcgttcacgccgcatccggcaataacagccttgcctgacgcaattactcttcgccgttaaacccagcgcggtttaacaggaactgtgccagcaacgctaccggacgaccggtggcgccttttgctttaccagaacgccaggcggtaccggcgatatccaggtgcgcccagttgtacttacgggtaaagcgtgacaggaagcaacctgcggtaatcgccccaccaggacgaccgccaatgttcgccatatcggcaaaattggactccagttgttcctgatactcgtcacccagcggtaagcgccatgcgcggtcaccggattgttcagacgcggcaatcagttcatgggccagcggattatggttcgccatcagaccagtaatatgatgacccagcgcgatcacgcaggcaccggtcagcgtcgccacgtcaatcaccgcttccggctcaaaacgctcaacgtaagttaacacgtcgcacagtaccaggcggccttcagcgtcggtgttcagcacttcaacggtttgaccggacatggtggttaacacatcgcccggacgataggctcgtccgccaggcatgttttcgcagcctgccaacacgccgataacgttaatcggcagttgtagctccgcgaccatccgcatcacgccgtaaaccgctgccgcaccgcacatatcgtacttcatctcatccatgccttctgaaggcttgatcgagataccgccggagtcgaaggttaaacctttacccaccagcacgattgggcgtgcatcttccgacgcgttgcctttgtactcaatcaccgacatcagcgattcgttttgcgaaccctgaccgaccgccagataggaatgcatccccagctctttcatctgctgttcgccgataacgcgggtgatgacattcttgctgtagctgtcagccagctggcgcgcttgtgaagcgaggtaagcggcgttacagatattcggcggcatattgccgagatcttttgctgctttaatcccggcggcaatcgccagaccgtgctggatcgcgcgctcaccgctggtcagttcacggcgggtcggcacgttgaacaccatcttacgcagcggacgacgcggttcgctcttgttcgttttcagctgatcgaaactgtagagcgtctcttttgccgtctcgacagcctgacgcactttccagtagttgttacggcctttaacgtgcagctcagtcagaaagcagaccgcttccattgagccagtatcattcagcgtattaatggttttctgaataacctgcttgtactgacgctcatccagctcacgttctttgccgcaaccaataaggagaattcgctcggaaagtacattcggaacatggtgcagcaacaatgtctgccccggttttccttccagttcgccccgacgtagcagggcgctgatgtacccatcgctgattttatcgagctgttctgcaatcggagaaaggcgacgtggttcgaagacgcccacgacgatgcaggcactccgctgtttctccgggctaccgctttttacactaaactccatgcactacgctcctgaatcttaaagacaacggcggtggctacagatagaattgcaagctttcgtaactcatgtccgctgttgcgatgacttcgtgttaatcttaacgttattacggcattggcacgtcagaacaaaatctgagaggtgaatccgttgagtataattatcttagcgacgatttcgacgactcaagagaataaatgacgtttaagccatgaaacaagctaaaatcctgcaaaagacgagtttttacgggcgtatttaaagtgataatcataagatatctggtgcgggagacgctcaaaagccagctggcgatactcttcatcttgcttttgatcttcttctgtcaaaagttagtgaggatcctcggcgcagcggttgacggcgatattccggcgaatctggtgctctcccttctcgggttgggcgtgccggaaatggcgcagcttatcctgccattaagcctgttcctcgggctgctgatgacgctgggcaaactgtataccgaaagtgaaattacggtaatgcatgcctgcggcctgagcaaagcggttctggtgaaagcggcaatgatccttgcggtattcacggcaatcgtagcggcggttaacgtgatgtgggcgggaccgtggtcatcgcgtcatcaggatgaagtgttagcagaagcgaaagcgaaccctggcatggcggcgctggcgcaagggcaattccagcaagcgactaatggcagctcggtgctgttcatcgaaagcgttgacggcagcgatttcaaagatgtgttcctcgcgcaaattcgaccaaaaggtaatgcacgtccttctgtggtggtggccgattccggacatttaacccagctgcgcgacggctcccaggtcgtcactctcaaccagggaacgcgcttcgaaggcactgcattgttacgtgatttccgcattacggacttccaggattatcaggcgatcattggtcaccaggcggtggcgctcgacccgaacgataccgaccagatggacatgcgcacattgtggaacactgacaccgatcgtgctcgcgcagaactgaactggcgtatcacgttggtattcaccgtgtttatgatggcacttatggtcgtaccgctgagcgtggttaacccacgtcagggacgcgtactgtcgatgctgccagccatgctgctgtatctacttttcttcctgatccagacctccctgaaatcgaacggcggtaaaggtaagctggacccgacgctgtggatgtggaccgttaacctgatttatctggctttagcgattgttctcaacctttgggacaccgtgccggtccgccgcctgcgcgccagtttttcgcgtaaaggagcggtgtgatgcaaccttttggcgtacttgaccgctatatcggtaaaactattttcaccaccatcatgatgacactgttcatgctggtgtcgctgtcgggcattatcaagtttgtcgatcagctgaaaaaagccgggcaggggagttacgacgcgttaggcgcaggaatgtataccttgctgagcgtgccgaaagatgtgcagatcttcttcccgatggcggctctgcttggggcgttgcttggtcttgggatgctggcgcagcgcagcgaactggtggtgatgcaggcttctggttttacccgtatgcaggtggcgctgtcggtgatgaaaaccgccattccgctggtcttgctgacgatggcgattggcgaatgggtcgcgccgcagggcgagcagatggcgcgtaactaccgtgcgcaggcgatgtacggcggctcgttgctctctacccagcaaggcttatgggcgaaagatggcaacaacttcgtctacattgagcgggttaaaggtgacgaagagttaggtggcatcagcatttatgcctttaacgagaatcgtcgtctgcaatccgtacgctatgccgctactgcgaagtttgacccggaacataaagtctggcgtctgtcgcaggttgatgaatctgatctgaccaatccgaaacagattaccggttcgcagacggtgagcggcacctggaaaaccaacctcacgccggacaaactgggcgtggtggcgctggacccggatgcactctctatcagcggtttgcacaactatgtgaagtatctgaagtcgagcggtcaggatgccggacgttatcagctcaacatgtggagcaaaatcttccagccgctatctgtggcggtgatgatgctgatggcgctgtcgttcatctttggcccactgcgtagcgtaccgatgggcgtgcgtgtggtcaccggtatcagtttcggttttgtcttctacgtactggaccagatcttcggcccgctgacgttggtttatggcatcccgccgatcatcggcgcactgttgccaagcgccagcttcttcttaatcagcctgtggctgttaatgagaaaatcgtaaccgaatgaacgaataaagggagcgaaagctccctttattattgttagcaaagtgtgcttcgttcattcctgaaaaataattaaaattcaatatattgcagtggggtgggcatgataagacgcgccagcgtcgcatcaggcaaagacaaatctcgcctgacttaccttcttctcccccccagcaaactccccaacatcccgcgtacaatctgattcgtcacttggcgagcggcgcttttggccattgtttgcaccacaccatctttcttcccgccgcgtggtccggtagtgccgaacaaaatatccttcaatccaccaagaatgccgtcatccaccgctacctctttccctttcgcgggaggattattttgctgctcggtactggcctgaaagcctttttgcaacatctcataggcggattcccggtccacctcatcctcatatttgccatacaccggagagtgattaatcaagccattacgctcatcttccgtcaccggccccatccgcgaacaaggcgcgatcaccatcgcacgctccaccacagaagggcttcctttcgcatccagaaaagagatcaacgcctcgccggtgcccagttcctgaatcgccttttcggtatcaaacgccggattggcccgcatggtttgcgccgctgccttcactgctttctgatcttttggcgtaaaagcccgcaaagcatgttgaacgcgattaccgagctgcccgagcacattatccggaatatcagacgggttttgcgaaacgaaccagacgcccacgccttttgagcgaataagccttatcacctgctcaatcttatccagcagtacctgcggggcatcgttaaacagcagatgtgcctcgtcgaagaaaaacaccagttttggtttctccagatcgcccgcttccggcaattgttcatacaactctgaaagcatccacagcaggctggcggcgtacagtttcggcatctgataaagtttctcggcgctgaggatattgataacgcctttaccgttggcatcggtgcgcatccagtctttgatatccagcatcggctcaccaaagaagtgtgctgcgccttgctgttccagcgacaacagcccgcgctggatggcaccaaccgatgcgctactgatattaccgtactgattctggaaggatttggcgttatcgccgatgtactgggtaattgcccgcagatctttaaagtcgagcagtaacagcccctgatcgtcagcaatgcggaagatgatattcagcacgccagattgcacatcgttgagattcaacagtcgtgccagcaacagcggccccagatccgaaaccgtcgcccgcaccggatggcctttctcgccaaagatatcccacaccaccaccggattggcatgcggttgccagtcattgacgccgatatttttaagccttgcgagcagtttttccgacaccgttcctgcctgcgcgacgccggtcagatcgcctttcacatcagccataaacaccggcacgccgatttccgacaatgactccgccagtttttgcagcgtaacggttttacccgtccccgttgcgccggtaatcagcccatgacggttagccattcccggcagtaaaaacagttctgtgtccggcgtgcgggcaattaacaggggttcactcatgagatatcctccagtttcctgcctggagtataggcaacgtccggcaaagagaatacgtgtaatgaagagaaaataacctaaagcgtgttgccgtgataaatctgatacccgaggtcaacagtgttgtggttgtgatcgttatttttaattttgctcagcaacatttgggcggccatccgaccaatatcaaaacggggagtaattacgctggcgaggcttgggatcatttgcctgccaatctccagcccatgaaaacccgcaatggaaatttgttctggcacggcgaggtttcgctcgcggcacagcagaagcgcacccatcgcaatatcgtcattggtgcaaaatacaccgtctaaatccgggtttgcgctaagggcatcacgcattaactgcattcctaaatgaatggatgagatggcgcgtggattcatgcgtaatggggaaagattatgcagcatcatcgcatcgcaatacccctgataacgctgttcatcgcgggtgtcatctttggaaccgagatacagaattttgtgcctgactcgcttctccagcatggtacacaccatgtcaaaagcggcctgccgattatcaaaaccgacctccatatccagccgttctccctgtacatccatcaattccacgaccggaatggtggctgaacgcagaaatttcaccgtcctgatggtgtgatatttttccgaaagtataatcccgtcaatgttataagagagcaggttaatcaccgactcttcttcggaatcgcgatcgtaattgtaattagcaataagggtctgataattatgctcagaggtgacggattctattcccgcgagaatgtcagcgaagagttgattttgaaatgacggaatcaagataccgagggtataactttgtgcattcaacaacatgccgggagcgcgattagggatataattgatctcttccataattttggcgatgcgctcgcctgtttcctttgccacctttttcggcgagcggatataacgactcacggtcatttttgttacgccagccagcgtagcgatatcctgtaaagaaattctgtgattgcgcataacttctcccaacgtcgggggaatcttcaatcttcccccgaaactacatcacaatattttattctttcagtgcaatacggcgttaatggctaacacgcccagcaaacccataatagaaataagggtttccatcaccgtccaggtacgcaacgtttcaccaaccgtcagattaaaataccctttaaatagccagaagccagggtcgtttacgtgtgacgcgatcacgctgcccgcaccggttgccagtaccattaaagcgggatcggcatgggtaacgttgataatcggcaacaccacacccgcggtggtaatggccgcgacggtggcagagcccagagcgatacgcaacagcgccgcaacagtccagcacatcaataacggcgaaagtgtagttccggtcattaagtgtgaaatatagtgcccgacaccgctatctactaatacctgcttaaacgcgccgccgccagcgataataaacacaatcatcgcgatagcgcctatagaatccccaatgatatccatgatttgctcgatggtgcgtccattacgtcggcccagtgtgaaaatcgcaataacaatggcaataaacagcgcaacggcagggttaccgacaaattcaaagaagaggcgcacggtgttagttttcggtaacgtaatttcacaaacggcggcgatagccatcaggatgaccgggatcacggcagcgaaaatactgttccagaaggagggcatctcctcttcgctaaacagatgaggattaaataagccttccggtggtgctttctcaaagcgagttagcagtttagaaaacagcggtcctgcgacaataactgtcggaatggtaatgataaatccatacagtaaagtcgttccgagattagcctcaaagatagtcgcgatggcagtaggccctggatgtggcggcagaaaacagtgggttacagagagcgctgctaccattggtacgccaacatacaacaggggtaatcctgatgatgctacgatggtaaataccaacggcaacagcaggacaaaacccacttcaaaaaacatggcgaggcccacaaccagaccggtgatcactagcgcccattgcacgcgttttttaccaaaagtagcaatcagcgtagtggcgatacgttgtgccgcacccgtatcagaaatcagcttgcctaacatggccccgaaaccgaggatcattgccagcccgccgagcgtgctgccgataccattttgtatagagtgcaggacggcctgtgcatccatcccttcggcaaatccgacgacggcagctaccagaacgagggcaataaagccgttaactttaaagccgatcatcaggataagaagcagcgcgacgcctgccgcaataatgattaatggcatagtctttatctcttattagtgccagaaaagcagcgctttcgcgctgcacgtaggggggctgttaaacagccactaacatgccgccatcaacaaacaacaggtggccgtttacgaaatcagaggcttttgaagaaaggaacaccgcagcaccaatcagttcctgcggatctccccagcgtgcggcgggggtccgtttgcacaaccaggcggtgaaggcttcgtcctcaaccagtgctttagtcatttctgttttgaaatagcccggcgcaataccgttgacctgaatattgtggcgcgccagctcgacgcacatgccgcgggtgagcatttttaccgcccctttcgatgcggcataaggggtgatggtgtcacgtcccagttcgctttgcatcgagcaaatattaataactttacctgccttgcgttcaaccatgtgacgagttaccgcttgcgataccaggaacacggcggtctggtttactgcgatcacatcattccactcttgttcagggaactcagtaaaaggatgacggcgctggataccggcgttattcaccagcacatcaatggggccgatgtccttttcgatatgttcaacggcggcatcaatttcatgtttatgagtaacattaaaaggtgcggcaacggcctgaataccctcctggtggagtttttctacagcaagttctgcgcgttcggcagtaatatcattaataattatttgtgcgccatatttacccaggccggttgccagtaaaaagccaatgccctgtgctgaaccggtaatcaagatattttttcctgccagtgaaaatagatcgttcattgtattattcctttatttatctcttagaaaacaagctggacttttgctgcctgggttttatcaccggcgaaacgtagcgcctcttccaggtcagtgaagggatattcagcactcagtaaaggcagtggattgataacgccattcgccagccatgacactgcggtattaaattcgctggtaaaacggaaagagcctctgagtgaaatctccttaccaatcaacgtcatcattgggaattctgccatcgcgcctcccatacctacctgcaccattacgccgcgtgcacgagtgacctccagacaggtattcactgatgaaggatgaccggacacttcaaagctgacatcgaaatagcctttttccgctttccagtgatccatgtcgtcgttttgtgggtttacgagcacatccgcccccatctctttgcccagcgaaagggaacggggactcacatcagcacagacaatttccgcggcccccagtgttttcactgcactgacaatcaggcagccaatgggtccaacaccggaaataaatactcgcttgccctgtaactcgccggcctgatgtgcggcatgaatcgcgacggctaaaggttcggcaaaagccataaccttttcgtcagctttggccggataagggacacattgcgacgtttcgaccattttataacgggtaaaaccaccatcaacatgagggaaatacatggcactgccaaaaaaacgcatatctgtacactgattctcgttatgttcaatgcagtatttgcagtgaccgcacggtttagacggattaatggctaccgtttgcccttcatgtaattctgatgagtcgctatgaataactttaccgataacttcatgacctaacaccatcggtgcctttatcatgaaattacctacttttccttcctgataataatgtaaatcggaaccgcaaattccacctcgggttatttgtactaatgttccattattattccaatctatcgtctgctcggtaacggcaacagttttcttgcccgcaacaacgcaggactgtgttttcacttgcataaattcctcactggtcaggtagacacctcggaagcatttaagcggttttaactgtcattatttgtgatgaagatcacgtcagaaaattgttacattactatgttacgcataacgtgatgtgccttgtaattcttatcagtagaaataaaaaaacgtgaaattattatgccgccaggcgtagtatcgcagcaggtaagatgattcaggagattttaaatggcgggtgaaagctttattttgatgggcgtttcagggagtggtaaaacattaattggtagcaaggttgccgcgttattatctgctaaatttattgatggtgacgatcttcatccagccaaaaatatagataaaatgtcgcagggtattccattatctgatgaagatcgacttccctggctggaacgcttaaatgatgcttcatacagtctttataaaaagaatgaaacaggatttattgtctgttcatcattaaaaaaacagtatcgtgatattttacgcaagggtagcccccatgttcatttcctctggttagatggcgactatgaaactattctcgcgcgaatgcagcgtcgggctgggcattttatgccggtagcgttactaaaaagtcagtttgaggcactggagcgtccacaagcagatgaacaggatattgtgcgcattgatatcaaccatgatattgccaatgtcaccgaacaatgtcggcaggctgtgctggcgatacgacaaaacagaatatgtgcgaaagagggcagcgcctcagatcagcgctgcgaatgattttcaaaaatcggctttcaacaccacgcggtaacgcgccttaccgtcgcgcacatgctggatggcgtcgttaattttcgacatcgggaacagttcggtggtcggcgcaaccttgctgcgggcggcaaaacgcatcagcttacgcagctcataaggcgtgccggtagcagaaccagagacgctgcgatcgcccgcaattaacgtaaaggccggaacagacagcggcgtgagaaccgcaccgaccgtatggaaattaccgccataggtcagcgcctcaaaatagggctgccagtcgaggctgacgttgacggtgttgataatgagatcaaactgccccgccagtgctttcagtgcctgcggatcgcggctattcaccactttatcggcacccatcgccagcacttcctgctctttcgccggattagaactaaaggctgtcacctcgcatcccattgcgtgcagaagttttatagcgatatgccccagcccgccaataccaattaccccaacgcggctggtagcagtgatatggtgcatcaacagtggtttaaagaccgtgataccgccgcacaacagcggcccggcggactcgatatcaatattttctggcagtggaatcacccattgccagtccgcacgcaacttctcggcaaagccaccgcgattcataatcgtcggcaccgcaccttgctcgcagttgatctgattaccgctaatacaggcgtcgcagtgaccacagctacgcgccgtccagccaatcccgacacgctgaccgacctgcaaacctttatcctgcgcggcgctcccgagtgccaccacgcgcccaatcacctcatgcccggcaaccagcggatattgtgaaaatccccattcgttatcgatcatcgacagatcggaatggcagatcccgcagtaatccacctgcacttcaacatcttgtggcctcagctcaccgggatcgtactcataaacttccagttcgccgcccgcttcttttgcggcatagctttttatcatcgacattttttggtccttctctggtgttgtttgggaagtgtagagcatggcagggcggggtgcctggagtgtgacaaaggttacacatcgctgtatgcaatgctgaaaatttcagcacttagcgaggtgcgagcaagctggcgcttgcatggtggcgtgcgacaggtataatccacaacgttttccgcatacctcttcagtgccgaagtggcgaaatcggtagacgcagttgattcaaaatcaaccgtagaaatacgtgccggttcgagtccggccttcggcaccaaaagtatgtaaatagacctcaactgaggtctttttttatgcctgaaatccagtgtttatctatctttcccgctatattaactctctcaaggtcaaccgatatcaacgtacatctaccaacatatgttggtacagatgatggtatttccggttcgataatgcttgtaccaacagggagggaatacgatggcattaacagatatcaaagtcagagcagccaagccaacggataagcaatattagctgactgatggtggcggtatgcatctgcttgtccatccaaatggttctaagtactggcgtttgcagtaccgttatgagggaaagcaaaaaatgctggcacttggggtttatcctgaaatcacactagcggatgccagagtacgtcgtgacgaggcgcgtaagctgcttgcgaatggcgtcgatccgggagacaaaaagaaaaatgataaggttgaacagagtaaagcacgaacctttaaagaagtcgcgattgagtggcatggcaccaataaaaagtggtctgaagatcacgcccatcgtgtgctaaaaagtcttgaagataatctttttgcagcgcttggtgaacgtaatatcgctgagttaaaaactcgagatttattagcacctattaaggccgtagaaatgtctggacgtcttgaagtggccgctcgtcttcagcagcgcactacagccatcatgcgctatgcagtgcaaagtgggttaattgattataacccggcacaagagatggctggggcggttgcttcctgtaatcgacaacatcgtcccgcgcttgaattaaagcgcatccctgagttgcttacaaaaatagatagctatactggtaggccgctaacccgatgggcgatagaactcactttgctgatctttattcggtccagtgagctgcgttttgctcgttggtcagagatcgatttcgaagcgtctatatggactatcccaccggagcgggagcctattcctggagtgaaacattcccatagaggctcaaaaatgcgtacaacgcatctagtgcctctttcaacgcaagctcttgcaattttaaagcagataaaacagttttatggggcccatgacttgatatttattggtgatcacgattcgcacaaacccatgagtgagaatacggtaaatagtgcgttacgggtcatggggtatgatacaaaagtagaggtttgtggtcatggctttcgaacaatggcctgtagttcattggtcgaatcaggtctgtggtctcgtgatgctgttgaacgtcagatgagccacatggcgcgaaattcagtgagggccgcgtatatccataaagcagagcatctggaagaacggcgattgatgctacagtggtgggccgattttctggatgtaaacagagaaaggtttatcagtccatttgaatatgcaaagattaataatccattaaaacagtaatcatcccgggcaaatgcccgggaattattctaggattattttctttgttaaaaaagacaaacggtattaactgatgtatttactatttaccgctccctgcaggggggattatcagaatccgcggttattcattatttatatacattcaataaaaaagtaacctcataaaaaatcctgtactcacagggtgatgcgggataactgacgtaaggagtgctgcagggatttgatggtcccttgtagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaccttgtgctgatatgaatacggatattttatacagaatacttttcagtacaagcgactgtattacagtctgccatatatgattacctgtgatcaggaagaataagtggctgaggtttcaaactgtctgccggtatattcctctctcccttaaaaaccataacaggttagttatcttcgtctgtcagcggattgaatggcggtatattttcagtacaaataccggtcatccactgaaaaatacctgcgaaatgacgggcactgatttttctactgacgggctgatgagacgttatgtcactggcggtaataatcagtggcacactgtagcctccctgcacatgaccataatgatgaacaggattggcactgtcgctgaccgacagcccaaggccagaaaagtaaagcatggcgaaatgacgtgagtaccggcgaaggataccatcaagctggccaagaaagttatccagtttactgatgctggcgaggtaacaggcaatttttcggggatactgctccaggtaattattcggctaggagttaaggctgtcacacggatttggatgagaacccatcatgtgcaggaaaattatcttcggagaggatgtatccgccagcgcacgttctgtttcctgtaacaacagtttgtcatctgttttacgggaagcgaagctgcctttcttgaggaaagtggcatgctccgcatcagaagcaataacagagatgcgtgtgtcatgctcccccagttttccttgattggatatccaccatgtgctgtatcctgcttttgctgccagcgccaccacattgttgccggaatcagggttctgctcatagtcataaatcagtgtccggctcagggaagacactgtactggaggctgtcgaggtataatcgtcaataaataaaccgggtgccgtattcagccacggtgtggttggtacgggatagtcatacactgacatataatccctgcgcacactctcaccagtgacaataacaatcgtatcatataacggtgctcccggctggattttccagttgtcagccccgtgctactcagttgttcataacgctgcatttcacgtaatgtgtcagttgtccccacaactgttcctttaaccatccgcaatggccaacggtttacagagcataatacgaatagccgtagagccagccagttacggtggtcgcgatggtgtgtccgccagaaaatcaccacgaataccagaatcgcggcactgaccagaaaatgataaacaggaaacacggggcggttcactttgctttctcctgtagtgttttctgtaggttctgaaccggttctagcggggttgtgaggctgatggcaatcgccgggctcttcctgcatgttacactggtactgcaagagggggccttcgctcctctgacattactcagtattttcactactacaccccatctgccatccataacaaccgattcaccccctcgcgaggcgttgttgcccgtcacccggacagacaccgttatggacttctcttgttgcacgatcgatcaattgttatgcatgctgacaccacaaccccggtgggtatgaccgatgcctttctcactctcttcccggtcatcgtcggccttccccgttattgtggcgtgtcagcaccctcgacggcatttcgatggctgctcagtgttcactcacgttacggcccgcataacccgttgacttcctgaagaagtcgtttcagggagagattcagcccttttgttacctcctggaccgcttcttgtccttccagtcggagcgagagttagccggggcggactttcaccgacggaaagatcgtgcatttcaaggcacacacaacaatatctgcgagcgtgctatccgtccggtcgttatgggacgaaaggcctggttgttcgctggttcactggtggccgggaaccgcgcggcacagataatgagccttctgggaaccgcagtctggagccacatgcttggctgacggacgtcctgacgcgtctgccggagtggccggaggagaggttggctgagttactgcctcttgagggctttaccttcttcgggtaagtgatacctgccgtcaggtgtttgtgcaccgggccataacctgcagttgggaattgaacgcctgacaacaggaaatgagctagagcagtaaacacgcgggctgacaatgggtcagaatatgagttagcccggcgttattcctggggtcagtacttcagatctagcctccggtaccagactagctagcccctacgcaaccaaataaatcaaccatcgtcagagtgcaatcgttcatatacactgtcggtgatgcgctaaaaaatgcgttaatgttgagttcctcgaacccttaccaattaagggacatagccagatacgcaactggctgatgcaagcagtctaatgtctttagatccgctggcctgcgggcatgacaatgtcaaacagtcaaagattgtggcgttgacggtcagtcttggggacaaaaaagctcagtattctcgttggcaaccagataatttaacagttgatgctgaaacgaaataggcatcttggttctgtaatgccagtcagttaagcaactgactggctctttttcggggctgtggggtatttccagggcctctcctttaccactctcgggaaggccctttcccttcttgtcggtaatttcacaagttgtcccatacttgcaagatcgcgcatcagctccggtatacgtcccggtgaagcgccctgcaatgtcatcagcattctcatcaccattccgcatgattctgagaaactcagttgattcggccagtaacctttcagatgttccgccattttaatcatctgatatctcaccagattataagccagtaagacaccccacagctcttgctccacaagctccggctttttacttctcagcgtcagcctgctccgttgcatcgtctgttttatctccctgtatcccagttcgatttcccagcgatgactgtacagatcccccatttctcctccggggaagcgcatggcgtccgtcatcgacgtcagcagatggcagacttttcctttgcgcgtcacggtcagcaggcgggcagtcacttcatttcccagtcccggccacttttttcgtgcctgcgggctggttttcagcttcaccagatgatcgcctttacccagttttctgatctcttcatattgcgctccctttctgagaggtatcatccagtggcggtgttctcccgccaggctccaggcatttaacagtcccagtgagtaataacctttatccattaacgtcagagtgttatcgccggtttgttctataagttgctcagcaagctcattttcgctgttcttcatcgtgccgaaggctgcagccgtcagcagatggctggtcagttccatctggcagaccattttgacctgcgggtagagcgccgggttcccggcatgtgtctggcgggggaaggctgcatcgttctctggtgtatccggtgtgcgccagaacacaccatcgatggccagcagggtcaggccgcaccagtgcggatgcggcgtggcgttatgccagagctgcgctgttttcgtgaacacgcggcggacagcctcacttcccaggcgctggcgggcctgaataacggcactgggggcaacgaaggggcgattgcccggcagcatgatgtccaggcgattcacaatctggtgaagaggttctttacgctcaagcgccatgccaacaatacaccagaccatcatttcgaggggaagacggcgcttgcgtagcgttacagtacctgattcggcaaggcaacgagagatgagttcggggtcgaggtaatcccccagagaagtcagtgggttacgcagagaatcgtaacgggataccagatcaagagcctgtccaatgtgcataaaaaaatccggaaacaagtgagcgtttccggattcttacacagccactggatcggtcaactgatccttaactgatcggcattaatcttggttctggtgtttgtaacaaactatcagctacaaaaatatgctcaatttgtgacatcagtaacaaaacgcgttttgttatgtggattgcttgttttttgatctggtataacaggtataaaggtatacagaaaagcaaagaaatactgcaaaggaaaacagctataacgtaagctaaagtaataacctctcagtctttcctcatttgacgaagggagttttattcaacctgaacggactacgaaaatgagcacaatgaataagtcaatttttgaagcagggttgaactgtgccagtggtggaatatctggcgaacattgttttttgttggtgacccaaaactgtaggtgggtatcagttttatctttcatagagtgaaatatgttaagaagaaatggaggaaaagattgtactgattaggtattgataacaatcaatagtactggcgtatttgaagacaatataattatttctggatattgttgaggctccctaatatttactttaagggctatattagaataacacaggaaacaaatatggcaacagcatggtataaacaagttaatccaccacaacggaaagctcttttttccgcatggcttggatatgtatttgatggctttgattttatgatgatattttacattcttcatattataaaagcagatcttggcattacggatattcaggctactttaatagggacagtggccttcatagccagacctattggaggtggtttttttggtgccatggctgataaatatggtcgtaagccaatgatgatgtgggcaattttcatttactcagtcggaacaggccttagcggtattgctacaaacttatatatgctcgcagtttgccgttttattgttggcttagggatgtctggtgaatatgcatgtgcttcaacttatgcggtagaaagttggcctaaaaatcttcaatctaaagctagtgcttttttggtaagtggtttttctgttggaaatattattgcggcacaaataatccctcagtttgctgaagtatatggatggagaaactctttttttataggcctgttaccagttttactagttctttggatcagaaaaagtgctccagaaagtcaggagtggattgaagataaatataaggataaatcaacatttttgtctgtcttcagaaaaccacatctttcaatctctatgatcgttttcctcgtctgtttttgtctatttggtgcaaactggccgataaacggactacttccttcctacctggcagataatggagttaatacagtggtcatttcaactctgatgacaatagcaggtttaggaacactgacaggtacaatattttttggttttgttggtgataagattggtgtaaaaaaagcctttgtagtcggtctaataacttcatttattttcctttgtcctcttttttttatttctgtgaaaaactcttctcttataggattatgtctctttggattaatgtttacaaatttaggtattgcagggttggttccaaaatttatatatgattactttccaacaaaattaagaggattagggaccggtcttatttataacttaggggcaactggaggaatggccgcacctgtattagctacatacatttcaggatattatggcttaggtgtttcattattcattgttacggttgcattctctgccttattaattttgttagttggttttgatattccaggtaaaatttataaactatccgtggctaaatgattggaggctttatgattaattatggcgttgttggtgttggatactttggcgctgaattagctcgttttatgaatatgcatgataatgcaaaaattacatgtgtatacgatcctgaaaatggagaaaatattgcccgtgaattgcagtgtatcaatatgtcaagcttggatgctttagtctcaagtaaattagtcgattgcgtgatcgtagccaccccaaattatctgcataaagaaccagtaattaaagcagcaaagaataagaagcatgttttttgtgaaaaaccaattgcattaagttatgaagattgtgtggatatggtcaaagcgtgtaaagaagctggtgtgacctttatggccgggcatattatgaattttttcaatggggttcaatatgcacggaagttaattaaagaaggtgttatcggcgaaatattatcatgtcatactaagagaaatggctgggaaaacaaacaagagagactttcctggaaaaagatgaaagaacaatctggtggacatctatatcatcatatacatgagttagattgtgttcagcatttacttggagaaataccagagacggttactatgattggtggaaatttggcccattctggtccaggatttggcaatgaagatgatatgttatttatgaccttggaattcccgtcaggaaaactagcaaccttagagtgggggagtgcatttaactggccggaacattatgtcatcatcaatggaactaaaggctctattaaaattgatatgcaagaaacagcagggtcacttaggattggcggtcagacaaagcattttttggtccatgaaacacaagaagaagatgatgatcgtcggaaaggcaatatgacctcagaaatggatggcgctatagcatatggtcatccaggaaaaaaaacaccattatggcttgccagtttaataagaaaggagacgttattcctccataatatcctctgtggtgcaaaacctgaagaagattatattgaccttctcaatggtgaggcggccatgtcggcgattgctactgctgatgctgccactctttcaagatcgcaggacaggaaagtgaaaatcagtgagatcattaaacatacatcagtaatgtaaaaactatacgcctcttgatttaattcaggaggccttttatgtatgatcaagaattttatcttcgataatctcataattttagcagtgccatttatgataaaaacatcccttaaaaccaatctaatctttttcttcctctgtgtatttgttccccatatggcgtcataatttacgctacgtaatacgggatagttacgatacgcagcgatagcgctaagttttagttaaaatcccccatcagcgggatatggggatctctgggaggttcaggttttagcatcgcgactttaatacgacagacgctggtgacgatgatgccaagtagtgactcttccgaataaggttcccactgaccaattggcgcgcgcttcgcaataaaatctcccttcgcccagtattgggaaaagtagatacattcaaactgtgtacgctgtttcgtctcacagttcacgacattgctggccgatgagctgaccattgggcctatccgggctgtcccgatggatattacgccgaagtatgtgggaattgccagcggattgatgaacgccggttccgctgtcgccgacattatttcacctatcgcctttggcattattatcgacaaaacaggcaactggagtttaccattctacggttccgtcgcattgcttgttattggtatattcctgacgttcttcatgcgtccagataagtcattgtaaaagtcgaatcagggctgaagtggcacactgaatttggccacctgaacagaggtgatatgctcacctcagaacaacacaggtgctccaatgaaaaaaagaaatttcagcgcagagtttaaacgcgaatccgctcaactggttgttgaccagaaatacacggtggcagatgccgcgaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacggattgaaatggagaatgaaatattaaaaaggctactgtagattcaatctgtcaatgcaacacccctttcaattatctctttcggtgttttgaacttcagtgtctttctcggtctgttgtttagctgagcagcaaccagatctagttcatgttgagtatattgggcaagacatgtctttttaggaaagtactgccgaattagcccatttgtgttctcatttgttccccgctgccaaggactctgaggatcgcagaagtaaactttaacgccggtgctgacagtaaattctagatgtctggccagttccattcctctgtcccatgtcagtgattttctgagttctgacggtaaactcaggaatttgtcggtaagagcctgatttactgagacagaatctttgcccctgagtctaaggatgatcgtataacgtgattttcggtctacaagtgtggctatatgagagttttttgtacctgagactaaatcgccctcccaatgccctagagagcgtctgttatcgatatttcgggaacgttcgtgaattggtgttccgttcactatgttaatcgtacctctttcgcctttgcgggtatgacgcctgccatggcgaaggctatgcgaccgtcgcagatgctgtatattcaggtggtgtagcgcttcacggctacgaaagtacagcgttttataaattgtctcaggtgatattcgcagcgttttttgacgtggttttgttcgccttaaccatcctgatatttgctctggagaccatttcatctccagcttttccagaacaagctttcgcaatggtaaattttgatccagtaagcacggttttggccttttcgccattctgttggctcggttattagcatcaacagctttgtaatagcgtctgccccgattacgctgaacttcacgtgagatcgtcgaaggactgcgattcagcgcagtagctatcgcacgaatgctcattttggctgacaaaccagctcgtatctcctcgcgctcagacagtgtcaggtgagctacagcccgcttacgctcatggggttttatgccgccagtatcccttaacatagtgaagatcgttccgggttttgaacccaggatattcgctatttcactgaagcctgttccgttcttccatagttcaaaaacagaggctttttcctctgctgtaaatgttcgtctcattcaaaaaacctccgcaaccccatgttttcacataactgttgcgttgaccaattgaatctacagttgctttttttaatatatctcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactttttagagtaacgttgggtttttctgctcattattagctccttctgatgccattctatttcaggaaggagtgtccgttaaactcaggctacctcaggaaaaaccgtcctgaaaaaccagacggcagacgggctgtattacgcagtcaggtacttgagctacatggcatcagccacggttcggccggagcaagaagcatcgccacaatggcaacccggagaggctaccagatgggacgctggcttgctggcaggctcatgaaagagctggggctggtcagctgtcagcagccgactcaccggtataaacgtggtggtcatgaacatgttgctatccctaactaccttgaaaggcagttcgccgtgaccgagccaaatcaggtgtggtgcggtgatgtgacctatatctggacgggtaagcgctgggcgtacctcgccgttgttctcgacctgttcgcaagaaaaccagtgggctgggccatgtcgttctcgccggacagcaggcttaccatgaaagcactggaaatggcatgggaaacccgtggtaagcccgtcggggtgatgttccaagcgatcaaggcagtcattatacgagcaggcagttccggcagttactgtggcgataccggatcaggcagagtatgagtcggcgtggaaactgctgggataacagcccaatggagcgcttcttcaggagtctgaagaacgaatgggtgccagcgacgggctatgtaagcttcagcgatgcagctcacgcaataacggactatatcgttggatattacagcgcactaagaccgcacgaatataatggtgggttaccaccaaacgaatcagaaaaccgatactggaaaaactctaacgcggaggccagttttagttgaccacaacagactacctgaagggagccgcggtcgcctggcagttgcagtagcaggagatcatccagccgcagtacaggtcacgatgactctggttaatgataccggctttgaccccgtattttccggctctatcgctgaatcatggcgtcagcagccgtgcacaccatcctattgttgtgactgggaggctgccaccatgcttcgcgctttccctctggcgaaaaagggagaaggacgggcccgtctgccttcactttatgccagcttcggtaagctgggtgagacaccgactcatgaagatatcattgataacaatcgatccatcaactggcctgtataacgtggctgccggtgattaagaaagctgcacctacctaagtagtagcaaacgcacactttttagaaaaatcgatggtcagaaactggattagcaattccgttccatggttgcttttgatttacgttggcgtctgatcattgatttatcctcaaaagcccaacctcattggtaatgaaccagctccgtgaatgtccgctctggcacagagcgaaattttttgatctcccccctgaaatctaaacttagtcatgtcacgtttttgggtttctaaaattttaacttcgcgtttttcgttgccgtaagggttatacagaaatgtccgttaagcagagttcaaaattgattgccgtgatcacgactggtttgaaagccgcgcccaagcctgtacagctctggtttgcgttgattatgaacctgtcagcctaaagcaagcggatggacgatgagtattggtaatctttcagagtccggaaaagttcagccccagtctgaacaggcttgctggcgccagtccagtttcattcagtcgtggtttggttcttacggcctgtgcaatctacctcattaggcacatcggcctgccagataccggctcggggtgtatttccgcttccacgctgaatactgttctcagcaatcctggggtcatcacctcttctggtgtgccttgcgccataacatgtccgtttgccattaccaccagttgatcgcagtaccggctagcctgattaaggtcgtgcagcacagcgaccaccgttttcccctgagtccggagttcgcccatcaaccgcatcaggtccacctggtgattgatatcaagataggtggttggctcatcaagtaatacaacgggcgtattctgggccaggaccattgccagaaatgcgcgctggcgctgaccgccggaaagctcggttaaccgacgaacggcaagatgattgatccgggtctggttcatggcgacattaactcgtgcattgtcttcagcggagagacgcccccagagtgacagccagggattacgaccatacgaaaccagctcctggactgtgatcccctctggcgttaaatggtgctgaggcagcagcgaaagcctgcgggccaactggcgcgatgagagcatatttatgggattatcgccgagaaatacggtgccagactgcggcattaaaagccgcgaaaaacagtttaacagcgtcgatttcccgcaaccgttaggaccgatcagggcggtgatcttccccgttggcagtgagagtgaaacgtcgttaagtaccttgtctgtcccgtaactgaccgtcagattttcagttcgtaaagtcatttatcgcattctcacaagcaaccagacaaaccacggcgcaccgataatggcggtcagcacgccaaccgggagctccagtgggggatgaataattctcgccagcagatcggcaaccaccaacagcaacgcacctgtcagggccgaaacaggcagcagtctgcggtgacgtccaccggtgatgctacgcatcatatgcggcaccacgagaccaataaagctaatcgggccgcaggcggccacgccggtagatgtcatggcgacagctagtaacaaagcccagaatcgggtatggggcaccgacacaccgagcgtggtggcgcgcgcatcgccgagtgcaaggaggtcgagatcgcggcaaaaactcaggctcagcggcagaaataaaatcatcagcgggatggcaatcttcacaaagctccagtcacggccccataagctgccggtcagccacagcagggcgttgttcacatcctgcgggcgcgagagcatcagataatccgtcaggctggcccagcatgcagaaagcgccacgccggtgagcgccagcttcatcggctggtgggtctttgccagcatcttcagcaatatcaaccccgccatgccgcccgcaaaggccagcagcggcagcaccatcacgggcagtgacggcataagaagtagagcccccacagaggccaggctggcggcatggttaacaccgagaatatccggtgatgccagagggttgcgcacaatcccctgtatcagcacgcccgccacggcgagggctgcaccgacaaacagtgccagcagcaagcgcggcagtcggtactccatcaatacataataatgctcgtgtccggcctgccagtcggtcagcagcgcgcgccacggcacggggatcactcccatatggagtgataacagcgcacagcccgccagggcaagggtgatgaaaataaccagcgcaattttcatcctcgcctcctcacaagccagacaaagcaagggctgccaatcagcgccagcactgcgcctgcgggcagatctccggggaaggccagcgcgcgtgcgagtacatctgccagcagcatcagcgtggcccccagcagcatgctcactggcagtacgttgcgctgatcgaagcctgcccagaagcgcgccagatgtggcaccagcagaccgataaacgccaccggacctgctacgctgacgcacgcaccaaccagaagcagcactaacatattgatgaccaaacgtagcctcgtcaggttcactcccagcgtatgggcggtgctgtcgctgaggttgagcaggttcagttgattcgccagcagcaacacgacagggactgcagtgaccaccaccggcaagagctgccagacatcctgccagcgggcgtgggacactccgcctgccagccagtaaaagatgccgtaagcatgatcttcggccagcagcagggtgatgcgggtaaggcccatacaaaaggccgacagcgcgatacccgcgaggatcagtttgtttctgtcatgggtatgacgaaatccgcctcctgcggtcatgaccagcagccagctcacgccgcccccgcatgccgcgatgaatgacagagaatagcctgcaatcggcgtcggactcagcgcgctggtaagcgccatagccagcgccgcgccgctgttaatgccgagcagtgaaggagaggccattgggttgtgggtcagggtttgcagcagcgtgcccgcgagcgccaggcttgcgccgatcagaacggcgaccaggcttcgtggcaaacgaaggttttgcaccagcgcttctggtagcgttggcgtgtgtccaggcagcagggcgcgggttgcatctgctccggaaacaggaatggccgagtagcaaaacagactcagccagaaaataataataagtgctgcaacgggaagcccccacagcagcaccgggtgttttatcgcggtcatttcacaacggtaagcggctgatggtggaagatttttaccgtgtcagcggcaatacgctctgcagcaaaaataccgcgcatccgcgcccaggtgttactgtcgaccgaagcaacctgctgcttctgcgcggcggttaacatctgccagagcggatcttgttgccagcgtttaacaatgctctcttcgcgatagtgggcaaccagcagccaggcaggattgaccgccagcagttgctccaggccgatggacggcatggacgcacccgccatcgcagcgggaacgttcagccccagagaggccagcacgctgccggtccaggtctcctgagtatgcaggttgaattgctgttcgcgtgatgtgccaaaggccacgcgtgtccctttgggaagctggctggcccactgcgccatcctctctttatgttgttccagacgtgcctgcatctctcgctttttacccaccatttcgccgatgatagccgcagattgcaaattttcagcgtaggtttcgttgcgggacttaagcagcagtaccggcgcgatttgctgcaaggcgatgtaaacccccgcatggcgactgctgtcggcaatgatcaggtctggtttcagagcggcaatggcttccaggctcggctgcgcgcgcgttccgacggactgccacggtttcaggtgcgcacgcacttcgggcaggatgcgttttgcatcgttatcgtcggcaataccgatcgggatgacgtccacggcggccagcgcatcggcgaacgagagttccagcaccacaatccgttgtggcgttttttcgagtgtaaacgtgccgtgttcgtcctgaaccgtggcggcaaaggcgtggctgatcaccagcagcaggcctgcaaaaagaaaacggataaatgccaacataatcacattccagctaaaagcccggcaagccgggcgttaacacatcagaacttcaacgacccctgcatatacagcgtgcgcggctggcctgcatagatgcctttgttgttgtcgtcataagagcggatgaagtagtcctggtcgaagatgtttttcacaccgaatgccaggttcagatctgccatctgcgggccaaagtcatacgccacgcgtgcgccccagagcatgaagccgggaatgcggccggtactgccgtcggcgctctctttcaccgtattggcgttatccgcaaactggctggactggaaatcgctgttcagattgaacgtccagtttcctggcttgtagtccacgcccagcgtgcctttatgtttcggggagaatggtaccagattgccgtaggtgtcgcctttctcgcggatttccgcgttcacatacgcatagctggcgtagatggaaacgttatcaagcgttggcgttagcgtacccagatcgtaacgtgcctgcgtttccagcccggtatggcgcgttttgccacgtgcagtgacggtgtcgttggtctggttggagtcgtactgattgttaaagttaatcaggaacagccccatttccgccgtcagcgcgccgtcgtcgtagcgggtaccgagttcccaggttcgcgctttttccggttcaacattgccgctttgcacagccttgccaatctggctgtactgtacggtgccgaacgagccttcagtgtttgcataaagattccagctgtcagtcaggtgatagagcacgttcaacgccggaagcggtgcgttatagctcacttcttcgtgcgtgcctgtgatggcgttgttctggtatgactcgatatgttcgaaacgcatacccggcgtgatggtccagttgccgatgtcgattttgtcatccagataccaggcgtgcgcctcggtgccggaacgcgtatcgcggtcgtaagggcttgagccggacggcaactgcccgctgctggtggcggtgtagtaacgcatttcatgcgttgattcattcaaatagcgatagcccacgcccacttcgtgcgcggaagggccgatcataaagatctggctgtagcgtggctcaataccgcgcacccagtagttacgcggcgagagggtgatgcgtttgccttgctccaggtagccgctgcgcagggtttgggtgtagaacccctgaatgttgaatttatgctggctgtctggctggaactggtagcccaggctcgccagcttgcgacgaccccagaagcggtcatacgggcgggtggattgccagcgatcggcgtcgtaatccgcgcgagacaggccaccgggcatgtcggcttcaccgtcgtaatattgcagcaggctgttgaaggtgtgcacctcatccggcgcatatttgcttttcagcatcaggtcgtcgatgcgggtggcgctgtgctcgcgccagtcactgccgcgcgtgccggagtagagcagcgcggtgccaaaaccgttgtccgctgtgccgcccaccatcaggttgtgcgtctctttcgggttgttttgtgaagaggttgggctgagctgaccttccacgcccgcctcgataccaaagtcctgcggaatggcacgggtaacaaagttcaccacgccgcccacgctctgcggtccgtaacgcaccgcaccaccaccgcgtaccacgtcaatggcatccatgttgccgagcgaaacgggagccagtgaaagctgcggctgaccgtaaggggcgaaggggacggggatgccgtccatcaggacggtcgagcggctggcgaggcgcgggttcaggccccggatgccaaagttcatcgccaggtcgtggctgccggtgccgttgttttccggcgcgctgacgccagggatgcggttaagtacctcacgcatggtggttgcgccggttttggcgaaatcctcacggcggatcacgtcacgcgcgccagcatgttcaaatacgtcgttttcacgcgcatcacccagccagtcgccgaccacggtcagggcatcttcttttggtgcgggcgcgggctccagcgtccagctgttatttcccagcggttttacctgcagtccgctgccgtccagcagttgttgcaggccgctctcgacgtcgtaatcgccgtgcaggccgttgctctgcttgccgcgcgtcaggctggcgtcaaccgagagggtaaatccgctgtgtgcggcatactgattgagcgctttatcgagcgatcccggtgcgatattaacctgtgcagcaaaagcggaaaacgagagaccggccagcggcagcaggctcaggcgaatggtgttaaccaaaggtgttgttttacgaaaaacgcgtaacggcgtcataccttccccatcatcatttttgttgtgttcagctatgagtcgaacgagaagggtaaaaaggacaatcgaaataagaattattttccttacagtggtgaaatgtttatccagtaccgcgtaatagactgaattttaacgggaagcgtttgcgcgataacgttcaggatcgcatcggtatttttcagcgggaacgtcccgctcaggcgcagcccggcaacggcgggatcgcagcgcagcacgccgttgcggtaacgggttagcgtggctatcacctcacccagcggtttatcgctgaagctcaggatgtccttcgtccagcttgtactctcgtcatccagcggtttcactgcgccaaactcagaggcgctgaactgcaggctttcaccagcgttcacgatgcgtttttgcgcgggggcactggcgagaagcacttccacagcgtgctgctgcacgtcaagctgcgtgaaattatcctgctggcggacggtaaattctgtccctaaagcagtgagctggccctgacgggtcaggacacggaaggggcgttgcagggcatctttcgcggtagtaatggcgatttcaccgtaccagagccggacggtgcgctgatgcgcatcaaaacgcacatccgccgcgctttgggtattcagcgtgagcagggagccatcttccagttgctgacggctgactgtgcctttggcggtgcggtaatctgcccgcagaccttcgccggtttccgactgccagagctgccagcctccgccagcgccgagcaacagcagtaatcctttcatcacgtgacggcgggtgaggcgggtatcgtgcaacgcccggctggcaacgtcgccaggcacaccgccaagctggttgcgcaggttttcaacctgctgccaggcccactggttatcctgatcctgttcataccactgttgccagcgcgcttcctgttgtgggctgacgcgctcgccgcttagcacggcataccagtgggaagctgaacgcagcgcctgacggcgggaatcggttaacaaaggattcataacccatactccagacggaacagcaggcagtgctcgacggctttcgccacgtattttttcacggagctgatggaaacaccgagtttgtgcgcaatctcgctgtatgtcagaccatccagttgcgaaagcagaaacgcttcacgtgttttgccgtttagcccgtccagcatgctgtcgaggagttgtagggtctcgagttggctttcgcgttcctcaggtgaaggcgctcccccctccggcataagcgccagcatctccagatacgctttttccagcgcgtttcggcgaaacaggtccaccatcacgcgtttggcgatagtgcagaggaaggagcgaggatcgcggatcgtcgagagcgtttcgctgaccattacccgcaaaaaagtgtcctgggcaatgtcatctgcatcaaaagcagactggagtttgcgcgtcagccagcttttcaaccagccgtgatgtgtgccataaagcgactcgaacgttaaggaagctgtggtagtggcgcggtcagacatgcggagtgcatcaaaagttaattatcacgtagtcatattaatatgagaatggttatcattacaattggaaataaaattgtttccaatagacatttttaacatgttgtttttctaagtgttataaggtaggtataaaatgggatggagcctctgcttctggcatgtgtcggtcagaatgactcatgatgtggtctgctattattgacatcctcactgccctaaaggatggggatttcggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctccttgccgtaaaacatggcaactacagttcacttacaccgcctctcagcccggtaagcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatagatgacggatggctggccgctgtatgaatcacgcctgaagggaaagctgcacgttatcagcaagcgttacactcagcgcattgagcgacataatctgaatctgagacaacatctggcaaggctgggacggaagttactgtcgttctcaaaatcggtggagttgcatgacaaggtcatcgggcattatctgaacataaaacactatcagtaagttggagtcattaccgaccatgtttatttcatacattgtgggtattgttcttattatcgccgctaatcaataaaatcctgccccatatctacatggggcagttgttcattcttttagtgtggtaattcacacgccagcaaaaactctgccgttccttcatcaacaatcaggtccgtgacatatcctcccagcagggcacccaacgttgcgtcatagcctctttccccaccagcaaggaagatcttccgttcaatctgccttagctgagccagactgattcccagaatacgctggtcaacatcagccacgacgggcatcccttccttgtcatagaagcgaccacaaatgacacctactgcgcctaaatcccgatacgtctgcatttccttcttattcagcacgcccacccgaatcaggggattttcatcaagcgcgttacccacgacaaaaaaggctttcgtacagcgagtcagaacgtcaaaattcgatcgaataataggctctgcctgtaactccatggccagtctggcgcttgataccacggcgggcacgtgcagcgaggcgacacggcctgaaagcttgtaggcgatttgcgatgaggattcaatgatcgtcaggtctggctgagatggcatggaaccgagcatctgtataacggtgacatttttacatgacttcggcgtcatggttttgctcatctgatggattgttcttccccaggcaacccccagcacatcaccattctcaatcacctgattcagatacatgccaccggcacgtgaaaggcgagtccgcatcagctttgtatcatcacgttttccggcatgttcgccatccggcacgatgatcactctctggagattgaatttatcgcgaatttgcaaagcagcgtcgatagagccaaagacattcacatccaggttgatatgaaccagtccattttcccgggctgtttgcaggtatttgacaaccgtgacgcgggacacccccatgatagctgcaacttcagtctggcttttgccttcctgatagtacagccatgttgcatgaagtacgggatcatcattgaacaggctgctgtttgtttgatctctatccacttttgtatacctgtattaaaccggggaaatgctcatcttaaccctgtttacccggagagttgatgcagattgccagtggcatgattttatacagatattttattcttttacatgaaataaaccagcataccatttgagcgatcgcccgctgttcccccatactgtaaagccggagacatgctccggctttacagtattactgagaatacacccatcaagcataatcgaaggttcaatatcgcccctttttgatcgccagcgattcgtcaccgtgcagacggttgccgtcactcactaaattatgggggacagtgaacaacaggttggctcactggcaagaacccgattataaaactaagctggcgagcagaataaaaatcagcccactgatggataagagtgtggacatcagcgtccaggataacagcgtttctttggtggtcaggccaaaaaagtctttaatcatccagaaactggcatcgttaacgtgagaacaaatacaggatccggcaccggtagccagcgtaatcaaggccaggttggtattgggatgtactgccaacaatgggatgaccagaccggcggtagagatcgccgcgacggtggctgaacccagacaaatacgcaggaatgcggccacgccccaggccatcaggatcgggttaatatccatacccgaaaccagggtggaaatatactgaccaacgccagagtcgatgagaacttgcttgaatgcaccaccaccaccgataatcagcagcagaccggcaatacccgcgatagcttttccgcaagaatccatcaggtcagggattgttttcccgcgccccaggcccatggtatagatcgcgaatagcagtgaaatcagcatggcgatcgttgaattacctaagaacagtatcacgttgtaaaataagcctgaatccgcggcacttttggcatgagtcatctggatgatggtgacaaccgccatcaggatcaccggcagcattgccgtgagaaaactgatcccaaagcctggcatttcgctttcgctgaatcggcgggtcgcgccgagagaggctatattcccctcttttttaaaggcgtccggaataatgcgctggcagaatttattcaataccgggccgcaaagaataaaggttggaatgccgacaatgataccgtatatcagtaccaatcctacatcagcgccatattccctggcgataacagtcgggccggggtgcggcggcaaaaaaccgtgtgcgaccagcaaaccagaaagcatcggcacacacataaacatcggtgatatttttgcttcacgggcaatagcgaataaaataggtaccagaagaattaaaccgacttcgaaaaaaagtgcgataccgacaataaacgccgaacagaccactgcccagtcaagtttatttttcccgaaataattcagcatggtcagcgctattcgctgcgcaccacccgcatcggccagcaagcgaccgagcataacaccgaagccaaatatcaaaccaatatggcccagcgtaccgccaagtccggattcgactgaggtgacgactttactcaaatccataccactggcgatggcgacagcaatcgagacaataattaacgaaacaaacgtattaagcttaatttttatggttaaaagcaggagtaaagcaatccctgccacaacgataattagtggcataacgtcctctcataacagggtagcgacccatcattatccgactgagcaaataacgaatgatgcagagtcggataattcaggtgtctggatgtttttatttatgctttcagtttttattcataaaatcgcgcaaagccgcgccaattttgtttacatcataaatacaaccggtccatgtcccaccactcacggcctgaagcattgcccatagccgggtatcatctggcaattcaggatcgggaagtaaatcctgatggctgggtctggcatttaatattgcagttgcctcctcctgtgaaggtaattgttcatcgctacgggttccgaggaaattgacttcgccgtgaagctcgcgacaatcaattttaatttcaattaaatccccggtgcgtaatttaccgatggggcctccggccagcgcttctggccccacatggccgatgcacgcgccagtagaaacgcccgagaaacgtgcatcggtgattaacgaaacatgcttaccgtatgacagatgcttcagggcactggtaacctggtaggtttcttccatccctgtacctgaaggtccaacgccaataatgaccagaatatcgcccgccttgatcttgtcatgtttgatatcgtaaatcgcacttttctcggacagataaaccttcgccacacctttatggtaatagataccttgctcatcaatcatcgaggggtcaatggcggtggatttgatcaccgaaccttctggcgcaatattgcccaccgggaaggtgatagttgaggttaatccgcgcgcttttgcttgctgcggagacatgatcacttcgtcagcgttgatttgttcctgatcgagcaggagttgcttgaaccgctgacgccgttcggagtgctcccaccagtcgaggttttctttcagcgtgctgccggtaaccgtcataacgtcttcatgcaacaatccgaggctgcgcagatgcaacatgacttccggcacaccacctgccataaaggcattgaccgttggatgataaaccgggccattaggcagtacgctcaccagtcggggcacgcgcttgttgatgcggatccagtcatcaacggtcgggatatggcaacctgcctggtgagcaattgccgggatgtgtaacagcaggtttgttgaaccaccgaacgcggcatggaccgtcatcgcattctctatcgctttatcggtgagaatttcccgggtggtgatgcctttttgactcaggttcagcgcagctcgcgcggaagctctggcgatctcccgccacacaggctcaccggaaggggccagggctgaatgtgggattgccagtcccaatccttcggccaccacctgagatgtcccggcagtgcccaaaaattgacagccgccgccggaagaggcacaggctttacagcccgcacggcgtgcgtcctgtagagataattcgccattggcgaagcgtgcgccaatggtttgcaccttgccgttgtcttctccatcctttgcgggcagcgtcgcgccgccggggaccagcacggttgcgatgttgtgctgcgcggcgagtgccatcatggtggccggaagccccttatcgcaactcgccacaccaataactgctttcgcgtcgggcagagagcgaataaggcggcgcattaccatcgatgcgtcatttcggtatggtagcgaatcaaacatccccgttgtaccctgagtacgcccgtcacaaggatcggagacgtacacggcatagggcagggcatggttggctttaataacctcggccgccgctttcatctggatgtccagttcgtaatgcccctggtgcaacgccagcgccacgggtttaccgtctgcgccgcgtaagccaccgagtgtactgagcagtaaaataccgtcccgatccagctcgtccggagaccaacccattccggcattcatggtcataccgaacagatccccgctcgggcggttgataagcatctctgcggttaatgggagttcgccgtccgggccatcggcgtgcgttctgacggtgtaaatatcgtggctctcgtcagcaaaaatattgcgaacagacatgagtttctcctcagactggtaaaatgccctgcgcggtaagcagcacgtggactttatcttttgcttcttcagatgcttcaagaatcggtggtaagcaatatgtctctacaggcagcccgacacactgcatgctgtatttgatcagtgagacaaacggtgtttcgagggcgtaaatagcgggcagttgtagtagttttttattcagcgtcgcagcggtcgccagatcgccttcacgccaggcgcggtagatgccgacggagagttccggagcaaagttagcgctggcggttatcgcaccgtcgccgcccagcagcatcgtattcagcaaatgatcatcgtaaccgcagaataccgaaaacgacgggcgtaccgacttaactgtgttgatcatcgtacgcaagtgaccaacgctgtcgatggtgtctttgatgccaacgatattctcgttttgcagagccagacgcgtcacggtttccggggttaagtcctgacccgtcagatccggaaagttgtacaggatcaccggtagggtgacgctacgggcgatctgctggtaatagtcgtcaagatttcgtggtgcgactttccagtagtaggggttgatggcgacgataccatcagcgccgtaggcttgcgcatgctgcgccagtttgaccgcttcgtcagtggaaggggaaccgacgccaatcaataccggcactcgcccgtcgacaatggttacagcttcttcggcgagtgccatgcgctgggctgtattcatttggctaaattcaccaccggtacccagataaaacagcccgtcgacccctttattaatcaggaagtcggcaacttcgcgcattgcctttttatcaagggttccgtcacgatgaaacgtgctggataccggtggaataatgccgctgaattttttcattacctcagtttccttttcgtaagtgctcattttcgtttctgtatcccagcccatatgatatttgctcagcgcatttccggagcaattccagatagctgtctatcttatttcctgaataaactaccggatcgccagaaagtgagattgcatagttaactctgttatacatattgaataccggcatacttaaacataccgccccataggttgattcttcgttgtctatggcccatccccgaaggcgtgttttttgtaattcttccagaaacaattttttatcggtaaatgtattgcgcgtatgtggagttaacgtgagtgcttctaaaaaataatccagttcttctcgtgtcttccaggctaataatgccttacccaacgcggtaatatgcaactcaagttttttgccaatccagcttttgctcgtcggtacagagtccggactttcgatcttgtcgagatagatagccgaaatgctctccatcgccccaagatgacaaaccagtccacttttcagcgacaactcctgcattggccgcttagtcacctcaaatatattttgacggtgtaacgcctgacaacccaattcgtagttttttattcccagtgaatagtagccgtttttgtttttaattaagaaaccacaatccaccattacattcaataaattaagcaggctgcttttggggtactggaatttatttaataactccatataacttgccataccaacccatgcaatgtgggttaatattttttcagcacggactaatgaattacaccctttgcgaaccataatggctcctccttgctcatggaataaatggtatcggcattacatagtggaaaatatgctttgttcagcatgctgaaccgtaatgatgtgattaaatgtgatcttgtacacactttgaataatgaatccagaacagccacatttagtgaatgagaataaaaagtagatggcgtgttgttgcaacatcgtagtgtgtggattgcgcctagagcttctttattcgttcgagcgcatcgccaatattttctattgggtgccattgattatttttgcttgaaatccctctcgaatgaacttacttatcactttattgaatgaggtaaaaacaactgacatccggctcgctgataacgctgtgcaatagtctcaggtaacccgctgtcactgatgatcgttttaatacatgatagtgttgctacagcatgcggctcaacggcatcaaattttgagtgatcggccatgagaataacttcacgcgagcgttgaataatccgtgttttcaccccgacctcaaacatggtggcattggtgatccccgtctccagcgacagcgcatcgcaggagataaacgcacgttctacggaaaaggcattgatcatctccagcgccagactctctcctaccgaaaaataacctgggcgaatcagtcctccgataatgtaactttccacatggggaaaacagcccagttcattggcgattttaatgtcgttgcagatgacctttacccgcgcatcggccaggcatttcgccagttcgaggcaggttgagccggagtcgagaaaaaagcagtcgccatctttgatcattgttcgggcaagggcagctatttctcttttcgccacagattgcaatgtacgtttcacgtcgaagacgtactctttgtcgtctgtactgtcgtcgaagtccaggcaaccgtgaccgcggatcatgcctggatactggttgacaatatactggaaatcacgacggacagtcgcttccgcatagccaaaaagctccatggcctgctgtgtggagaggtgacgatgttgccacaggtagtgcagcatctgtttgatacggtcaggtctctgttggctcatcagaaacaatctcctcttacagggtggcgaattgagctaaggtcgcgcgatagtcagatgaagagaacagggcgcgcccaatcaccatatgttgcgccccagctgctgccagttgctgtgcagctgccagcgtaattccaccgtcggcccagcactcggtctgaggaaaagccgtgcgtactttttggattttctcgcacatggagggaataaaccgctgtccctgcccatcgggctcactggtcatcaccatcactccgtccagctcagacgccagatatcgccaggcgtcgatcggggttgccggattaaataccagtccggctcgtgcgccggtatggcggatctcagttaacgtttccgaaggatagtccagcgtttctgcatgaacgaagatccacgcgggtctgatttcagccagcgcgttaaaccagcgctgtggccgggcaagcatgaaatgaaaggacaagggatgaggcgtctgtctggcgacggcctgcaccgttttcatcccaaacgtaatgttgttaatgaagctgctgtcctcaatatccagatgcaggctcccaaaatccagattgtccaatgccgtcagctcacgaccatagtgcagaggatttgcgctggcgagagaagggtgcaggatcataagcgcctccgttaacctgataccagcgcaaacagtgcatcgtctgtgctggcatttcccactgccgttaagcgttgtggcgaatcaataaactggctgatgcgctgaatggtcaaaatatgtgcgttggcatccgtggcgctgacgcagagaagcagccagacggggtcgcactcctcgttaccaaaggcgaccggggtgcgtagcgtggtgatactgacctgattatagtttgcgccttgctctggtcgggcgtgaggcaaggcgattcctggggctatcagataataaggcccccagttaagggtattttcgatgatcccattaacgtagcatggctgcgcggcaccataggctaccagcgggcgggtggcgatttccacggcctgacgccagtcggtggctttacgttgtgcctgtacccatttaatatcgttaatcatccgtcgttgactccatgccgattcgggttaatctggtagcgatccccgtcgatacttttgacgaaggcggcagggatcgcagaagggttattgctctttgccggggataagcgctctgcttatccccatcttatcggcgtatatgatgcactttctccataaactgactgactcgcgcctggtcaacgaaattggcaaaaacgccgtcctttttaaaggtggttgcggtcacacagccatcggcgatactgagttgttcctccacgttttccaggcagacgcccgtgttggccaacacgacggtgtcaggcaccgtttctttgacccgttttaacagcgcgctgtcggtacgcgtcccggcggtcaggccagaaacacagagcgcatcaggatggttgttaaatactgtcgatttagcaatagaacagatatcgcgattgcccagatacacggcggcctctgggacgatattgaacaaggttttcacttcgcctgcaccaatccggtgttgatgacggatggtctcaccgacgttagtgtcccagacgccaaagtcgctggcataggcaccggtaaatatctcgcggataaacttagcgccggtagccatcgccaggtcgaatgaggcgaccggatcccacagaacattcacgccaaacgggatgcggatatcgctcattaattgcccgatgattcgtgccattgccgcagtggtttccggacgcaccttcgtgagatagggaagactaaactcgttggagaacatgactgcatccaccccaccattttggagcgccatcagatcgtcccaggctttgtcgataacccagttcatccccaactgcgcatcaaaactcgggtcgccgggcaatgcacgtagatggcacatggcgatgaccgctttttccgtcccaataacctctttcagccaactcattgaaagtactccttattccgataattcacgtttacgtaagaacagcacgacgctggcgacaataccgaccgccacgacaacgccaataatcccaagcgacatcaattcagaaatcgaccaaccgaacatattgcccacggacaacgctgagatttgcgcactttcaccggcaaaactgaaaccgcctttgagcgccatttcagtgaagtaaggcgcgaactgggtggcgatcagcaggacggtaatcatcacgatgaccccgcttatcaacgtcctgaccaggtctccgcggtggataaccgtagccatacagataaagaacggtgctaccggcaggtctgcgaggggtaacactttgttgcccggtaaaatgctggccagaattaacataatgggtatcagtagcagaccgacagcaatggtggttggatgccccagcgtcacagcagtatccagaccgatatacacttcacgtcctttgaaatatttctggaagaactttcttgcaccgtcggagatgggcagcaggccctcaacaatcaggcggatcatgcgcgggaacaacaccatgattgccgcaacggtaatcatcagactggcgcaacctttaaagccttcaccagccgccaggccaaaaatcagaccgagcactacgccgataatcaccggatcgccgaccatgccgtagcgtttctggatctcctgagcatcgatattgcgtcccttcatgaaagggattttttcatagatagcatcaagtagaacgaaaagcggtactgaactggaaccgtagccttgcggtatcgaaataccttccagcccgacgatgttctgtacccgttttgccgtccagtcggccatttttaacgatagcgccgcatggcagattgcccccagcacaccataaatcaggctaccggtcataagctggaccaccgtacccgtaatggcgtagtgccagtaattgtaaatatcgacgttcatcgttttggtcagacgggtgaccagcatggcgacattgagaagaaaaataactgggataatcatggcgccaatggctgtcgcataaccaacgccggaggcagggcctgcgccaacgtcaaagacatgcagggctaggccgaaacgctcaatcatcactttgatagggggactgaggctgtcgatcgccatgacgatcaccagtcccataccgacaaaaccaatcccaaccgttacccctgccttaatcgcctgcagccaggggatgcggaagataaggccaatcacgatcatgatgatagggacgaaaacggtaccgccgagagacaggatgtaatcaaacataatgcctccttttattgagttaacagagccttgatttgttgttttaacgcgtcgtcgttgatccctgtgagcagggcggcgccattaagcgtagggatgccgtaatcactgttggttcgcatggaggttacaataaggtccataccgttacagttaagagggatctcattcagacagcattgggcggtagtggctgaaatgccctgttcagtcaggaactcttgcagcttgtgtgcaatcatggttgaagtcgacatgccggtaccgcatgccacaaggatctttttcataatggatgtgcctcttgtgtagtgcctgaatcaggctcaacggggaaatgtgctgctgacatacctgccagagcggtcaataggcggatgcaatcagtcaaatcacgcaggctggcaacctccgccggagaatgggtatagcgacaaggaatagagagactggcgcagggaataccatcctgctcaacctggatataaccggtttctgttatcacgccgggagccacttctcgctgcaccggaatgttgtgttcaagagccgtctgttccaacatccgtatcaggcgaggaggcgtgattaatccggccagcgttccccgaccatggtagttcaggcaggtgatcccaacgccctgattaatcctgacctcggaataatcgtgtaaatcaggggtgtcacacgatggagtgatatcaataccaatcgccaggtcaggttttacacggcgtaatacgggaacaatgccgcggatattaaattcttcctgtaccgaagccaccagataaacggcgatatcaagctccatagtactgatagcatccgctacaccgagcagggcagtacagcctagacgatcgtctagtgctttactgcacaccagatcgtttgccaggagttgcggcgggttatacagagtgacaggcgtaccgacctgaatgcccatccgtatagcgtcgtctttgtctttggcaccaatatcaatccacagtttgtcgacagaaggtgactgcgtgcgctcgtcgcctttggcaaagtggtaggacttaatgccgatacaccccatgactggccctttgtccccggtgagggtgacgatggaaccagccatagtgacctgcgcaggaccgcctacgcgttcaaagcgtaaaaatccagacggctctattttgcgcaccataaaaccgacttcatccatatgcgcaaaaatcatcagtcgcagcgcatcgggtttatcactaccgtagcgcgcgacgacattcccaagcctgtctcgccagacctcttttgcctgacgcctgaattcgcacagcatgacgtcagcgacagcgttttcgtgtcctgaaatcgcattgtgctgcaaaagcgagaacagggtttcctgcacagaaaatgacatagctatctccgtagaccgtaaaacaatcactcgttgagcgttttataggcgcagactggtcgaataattgtgagaacgttcacgtgaaaacgcgcaaagctgaacaaataaaaaattatgtgagccgagtggaataaaagcgctcaacgtttgtgaaagttacgggctggagagaccagtgattatggttgaaataatgaggatgaataaaacgcggtaactgttatagcaccactttgttgcaggacgctccctcttcattacgtcctgcacgtggataccccagcatctccatcagcggatcttagaatgtaatggcgcgtggcaggtcgttggttcccagcataatgtaagaaaacatcggatctcctgaatagattcagagggagtatagataatcagctcaaatcactctccgctttatgagcccaggctggcattgccgtcagataacgttttgcacgcttatgtgcttcctccgggccgactttttgccaggaatcaaggaagctggctaaacctgataccgcttcttcccagggtttgagattgccgttgctgtcgctgcattacgcacaatattgatcactggcactgtgtgcatctggtgccgacatcggcattccgcaagcctgacagaactgttcatgttgtgacatatgatgctccttatggtgacatcttgattaataaacatactgaatatgtattgtgcaggtgatacatcagatcaaagcaaaggtaaagcctcgatatttccagccagaaataccgggaacctgttgttaccgggcgatgagtgcgaacacgccccagccaaagcattcccgcgcgtaggtcacgtagcgtttcggcgcgatgtttagttcggccctgacttcggcggcgaagtcatcgtcaggattcgcttccagccagcggcgcatggtcagccattttgcggcttcataccggtcccagccttcctggtctgccagtaccatttccaccacgtcatagccgagatcgtcgaacgctccgacaagtcctggcagcgtcaggaaatcgcttgtcgagctgacgccgcaggcctgggctatttcttctgttgctggtagctgacgccagtagggttcgccgataagcatgatcccgcccggtttcaggctttgcgctagcagctcctccgccccggcaaacccaccggcaatccatgtcgcgccgacgcaggccgccacgtcacatttttcatttgcgacgtaaccggccgcatcgttatgaataaaatgtacgcgttcgctgacgccgagttcttccgcgcgacgctttgcctgcgcggtgaagagcgaactcatgtcgatgccagtccccgtaatgccatgatccctggcccaggtgcagagcatctcgcccgagccgctgccgaggtcaagaatgcgggtgcccggcttcatgcgcagcacgcgacccagcgtggcgtacttctcttcggtgaacgggttatggatgcggtgttcactttcgctgatggtaaaaatacgtgggatatccattatttaattcctgttattgggttaagccttaaaaaggacacaacaagattgttattcacgtcagtgctccggtttcatcagggtctgcgcaccggatgtggccggtcagggtcatgggctgagcggtgagtgattgcatcatccagcaggctttgtgctcctccgggatgggataaggtgccggatagcctttgtctccggcacagggttcgaacccatgtcgggggtaataggtggcgtggccgagaacaaaaaccgtctggcagcccatcaacctcaggtgctcgatgccagtgcgtatcaaccgtcctcccacgcccatcccttggtattccggtatgaccgccaggggagcgaggatgtgcatcaacggtgaatccatttctcctttgaaggttgcccgggtaaataaaatatgcccgacggctttgccttcataccgggctagcagcgataacgcggggcgcgcgctttcatcctcaagtaaagaggccactaaatcggcttctttgctgaagccaaatgcgcgggtttcgacttcccggatatcactggcatcacttttatctgtgatatgaaaagtgaagtggtgtactgtcatagaaactctccttagcgattatcgagctgagcgcgaactttattcagctcggtggtgttgattcgatagggctggccattgacggacttgataagttttttggttttgagttttttgaagacggcgagcgtgcagtcggtcagcaacagcccttcgcggctgtagcattcaacggaagtgacgcggcctgaagaatcgcggacgtgcgcaatacgtctacctttagcgagaacgtgtaaggtatgttgttcctgacgggataaattcatactgaagaacctatttaatcatcatgtgcaaaacgtgcaaacacaccgcggtgtccgcattcgatttcggcgcattgataatcagtccggcctgaaaaggtcggggaactgattatcggatgattacattctccagcatcaaagcctcgggttgagttgaaaggtatttacggagcgaatattaacacgtagttataggagggatatgtttcagtagaaaaagtgtgatgtactttggaaattgaatgccaacccatttactggaaaaggcagatgacactgacgaatgcatgttgaagtacgcctgaaatggcctcatcggcttttcccttcgggagattattctccttttgttaaatccagaacataaatatgctcacccatcttcgatgcttgaaaaattgaagccaatcctgataagtaatttttttgaaagggtattttccggattcacaccggctttgatgagtgaaaaaccgttctcttttattcagtcaatcgtggcggtaattgcttcaattgcatatccctggcgagcataagcgggactgatggtatagccgagccaaaacacatcgcattgctgacgtaaatagatatcaccaatcaaaacctgcgtcatttgttgacaatggccaattgaatatcgcgagcaagtgtaagaactcccagcaagaccctgtaaataattctgtgtaactgcccacgattaaaggtggccgctcaggcggtcaccgtattcgataataaatgggtctggaaaaagtgcagcatctggcagcgtaatgcaggtagcccagttcaactctcactaccagtatgatcccaagttcgagcgcggaatgtatctgtatgagcatcgtcgctgtttcaataacatcatcgactactgtaactcactttgctatcacggtaagttgcagcctaaaagagggatggaaaaaggacgattttccccgcaatgggatatttacatattgatggtagaggcatgaagccaaatggagggagccgtcataaccctcttgaagctgaaacaatagcagcatggctggtggcacataaggatgatatagagcgccattacggggaaccactgtacaaagttgttggtgttgtgacgccattttcggcgcaggttaatgctatcaaaatgtcattgcgtaagctggaaattaatggcaaagacgagcagggtttactgacagtggggactgtgcactccttgcagggggcggaaagggcgattgttctcttttctcctgtctactcaaaacatgaagatggcaggtttcttgatagcaacagcactatcctcaatgttgctgtctcacgcgctaaagatagttttctggtatttggcgatatggaccttatcgagatgcagcccgcattttcgccgcgagggttattggcaaaatatctcttttcttcagataataatgcgttgcaatttgagtttcagaaacgacaggatttaatttccgcacatacacaaatttcaacgctgcatggtgtggagcagcatgatgaatttttgaacaagactcttgccggagctcaaaagaaaataacgattatttccccttggttatcctggcaaaaagtggagcaaacgggatttctggcatcaatggctttggcccgttcccggggcattgatattaccgtggtgacggataaaaactgcaatatagcgcatgtcgatgatgataagcgtcaggagaaacaacatctgctgaatgatgctgttgaaaagctcaataagatgggtatcgctacgaaattggttaatcgtgttcacagcaaaattgtgattgaggatgaagaactgctgtgtgtcggatcttttaactggttcagtgctacacgggaagataagtatcaacgatacgatacgtctttggtgtaccgtggtgaaggcgtaaaaaatgaaataaaggcaatatatggtagtctggatcaacgtcagctttaaatgtgatgagccgttcatgatacaggagtagtaaagggcatattttaccaatgttaaggcgactttccgttttattgcgagtcgcctttcctgattataaatcttattgtttacctaatcattttcctttgcataatgcgcctgggattaatggcgggtgcttttaggaatgaaagaaaatgcaagcaataatataataatggcctaatttctttgaacatcattaagcatatcatcatcgtctatttgccagaatccgtcgacttataatcgccagaacggcatatcaggacggtgctgcgaacgctgtggcccaaaacgttccagtaaactgtgtagatgttcgtagatttccgagccataatcgaaaaggcgcggatgtctattaaggcatccggctaatctgtaagcaataacaacggtttatgcggtgcgcgtttttcacccttgtgccagattattatattggcaattgcctgctgttcgagcccgcaagtgaagagatattaccttgatctcatttgttttttgttgtctactctgagaacgaacaaggacatcccccatgaataaactccccgctcacctttcgcgccaaaactgcaaaattgcttctacaaatctgtcagaaataatcccccgacgggctgcagtgctgaaatgactgcttcgcagtgccgtcgtccagttctccggtgaccggtacgctgaaccgtaatatcccgtgcttaaatcgtccgggtcttcatcaggcgcgttcgtcagtcctctttcaccttgttgctggaagtcgacgaaaataatattggctaaaacattattttgataattgccataaatagcttcatacgaatgcgggaaattttctttccagtaccaggtggtatcgccgcaaaaccacggcgcgtcagtaatattattaagctgagaatggtattgttttagatccctacgaaaggcttcaaccatatgattaaagtgttgagggtgtgacgcgtagtcactggtcattaagtcaaattcgccttgcatccagcatgcgccgaggaatttgttctgcggattttttgccagtgcggctcgcgttctgctgactaaatcctggtacagcggagtatccgttccccaacgacaagcatcatggctggctccgtgccgttctgaatatgtcccttcgctgcccgcggtaaaagccgatccgccacggcaacacggaacgataagaatccctgcattatcaggaatgaagggcagtaatttccgtgcaatatgcagtgcctggccaacggtgccgtactgtgtttgatgattcgttgccagaggatggtgataaccctgcatatcctgaacatcgtgtgggcagtgagtcagtggaataatgtcgttaaagtgacatggcgggcctccgggatgcgtatgcgcaaatctcgctaattgtttaattctgggatgaggcgcatcttccctgtccggtaatggcagtccttcgccatacgccatggcattagactgaccagcaacggtaagaacatagtaataatcgggcgatattattgcgttcatataaatttcgcgtaattgaaatgacaaattgatagcagggcccctttaccggggccctgaagcgttagttttgtactgtgactttattatccttcacagtgatcaaaactgaatccgtcaccgctttgccgcctgcagtttcaccgccaataatcaatagactattattccagggcaatgatactccgtaggcccgaccttgcgataattcacccgatttatcccatttcccgttatgccaaagatgaatatcagtgctatatgattttttcaggccttcatgcgcatagttcttaccgttctggtaattttctcgtgaacctttgaatccggcccctccggcaaatataagagaatcattgcttatccccgcaaaaccgccagctacgccatctggtgatgagacgggagcaagcttattccattttaaattattaccggtgaaatcaagttcaaatacggcatccgttcgcaatcctggtttggcttcgccattaataagccaggttttatcacctttattcacaaccgccgcaccagccgttccgtaccagggcgattcgccagcgtaactccattgctgtgttgagggatcaaaagacaacagaaacttattgaagaaataatcttctgcttttttgtcaaaatagtgagcattgattttatctatagcggttgaatcttttccagcctcgttgagatcttcaaaatagccattgaagatattctggttaacaccaccagtaacataagccttgccgttgtgtacaaaagtcacatggcccgccatgcccatcggcgcgtgcgacatcaatttaacccaactattggttttggggttgtatttgtgtacgtcattaaatacctgagtcaagccctcgctgtttttgccaatgccgccaaacacatacagattgccatcaataaatgcagaggttgcttgatctcttggtccgccagggaatgcagctaacgctgtccattttttatctttggcctgtgtatccagcttgtaccatgccgtacctgcgctacctaaaccaatgtagacagtgtcgttatcaattgctccggtaccacttttaaatggcacaggagtttccggtaatacagacgcgtttgcggcaaatgaagccatcatgatagcaagcgccgttattgttttattcattgtgactgtctcctgtctactacagtttaaatgacacaccaatgcgataactgttttccgataaattatctctgccgttgtaaacaccctgacggtcaaggtagtcatattctatgtatggcgtaatatcgggcgtcatatggtattgtagaacaaatgcattttccgtcgcccatttcttatggtttgcatagcgataatcgttctgtttgctgtatagcgtcgtttgccatgcgaaggtgaaatcactattaatatggtaagtgacatatccatcccaacgatgaacgttatcacgagacatatcaccggataagtcttgttgtcggtaagctttccagtcgtaacgatagcgaatgccaaaattaagatcttttgtcgcgtcccaggacagttttacgtagggtccgtagcgtgtgccgttgctgctaaaatgcgttaacattcccgggcgcaccgtccattgatcatcaagtttaatcgcgtaattaacttcaacctgaacatcattgagtgcggcattttcctttttattatcatgaatggtattccaggtattactttccatgcttgcccaccatccattttgccatccctcactgactttgagtcgagtctcataggcgtggcttccactacgatatccaccacgtacgtccagtgtcgcagcctgagaaattaatggggacgaaaagcacagtaataatacgccagaaagtattttagcctttttcataaatttcactcatttgtaggatacagaaagcaatacaaagcccgcataaacaattagcatttatgttgtgtaatatttttttgccaggcttatagtgtctttggcaaccggtagctgtattttatatttttttgtataaggtctcctgtgaaaaatctcttttcacattatttaaataaacagagatccagattaaatacctgagtataaaatctcttctgatgtttaattgatttgaatgttcgtaagctatatcacttactcaatccattttacccagagtcataaaatagaatgtctgttgatctcattttcatattcctttcagactgaagtgcgttttcatcacccgatgagaaagaactgaagtgatgtttgccatagattgcgagatgccctgtctcattgactatcttggtgcacctttatacctgttataccagatcaaaaatcacgcaatccatacaacaaaaccagatttgcaattcgtgtcacaaaatatgtcgatctttttctaagaggaagatgccatgtgaagccagacgaacacttgcggtggtcttcaaaaactaaagatcttagtttaactatttgttttataaataatttattaagagtctaaacaaggggagctttgcaagctaactcagtgagcttggtgaaaatcagtgtttacccgccatcaggctgagcataattctcatcatgaaatatgtttcctggtttgtggcttgtaactggtcacttctgaagtcgatctggagaggcttgttgatgttggtgttttcaggatgatgtttcacttagtttgtttgccgtatcgcccggcgaatggctgtgattgaggaaggtttaagtcgtagtgaccaaagctatatttaccaacgaatgtagatgaaaaaatcatctcctgcgttcccccatatctctaggataaaaaggaatgtaacaatctcatggcgtaagctgacgaatcagcaggaataatcgctagggacctaagaattagcatgataatagccactaagaaattactgcgctccatgaaatagccattttgtggcaaatggagttgactaataatgtcatatgtgagacggctagttgaacgaatattaaattttgctgaattttttatgttgattttacttgttacagaacatatcacatgatatatagataagattagttgcattaatgatgagggttattattagattcgtatccgattgataaatatataaaggtacatagcatgcaagagcatggcgtttgtatggcaacgttattataattaacagttgctactccatttaagttcactcagaagaactggtccacttacgttagttattaagcaaacgttcgcttttataaacataatcaggataaaaatgttggattattgctaacccagcacagctagtgcgcgtctgtaattataagggaaaaacgatgaagaataaggctgataacaaaaaaaggaacttcctgacccatagtgaaatcgaatcactccttaaagcagcaaataccgggcctcatgcagcacgtaattattgtctgactttgctttgttttattcatggtttccgggcgagtgaaatttgtcgattgaggatttcggatattgatcttaaggcaaagtgtatatatatccatcgattaaaaaaaggcttttcaacaacgcacccgctattgaataaagaagttcaggctttaaaaaactggttgagtatccgtacttcgtacccgcatgctgagagcgagtgggtatttttatcacgtaaggggaatccgctttctcggcaacagttttaccatattatctcgacttccggtggtaatgccgggttgtcactggagattcatccgcacatgttacgccattcgtgtggttttgctttggcgaatatgggaatagatacgcgacttatccaggattatcttgggcatcgcaatattcgtcatactgtctggtataccgccagcaatgcagggcgtttttacggcatctgggatagagccagaggacgacagcgtcacgctgttttatagagatagttgagataccagggatggtgttaaaaactacattattcttacgatatatcaaaaatgattaaccatttattaattgatgttattgtaagtgtgattcttaattatcataataaacattaagttaaccatatccatacaaaatacaatggtttatgttcttcaaaataaataaacaaaatcattcataaatttacacatcacttaaaatctcctgtttccgcacttttttctttattttttaagcaactggaagttaatccactgcaatctattgttatattgaatcaaatcaatgaaaatagatgttgtcacatcagtgatattttatttttgtatgatatttaatgtaattgactgatagccacatcactccgtgtgtggttatctttttatctattgggctaattttgaccgattgaggtttcctataggtattcattcaaatatatctcagttaggagtactactattgtgagtaaacgtcgttatcttaccggtaaagaagttcaggccatgatgcaggcggtttgttacggggcaacgggagccagagattattgtcttattctgttggcatatcggcatgggatgcgtattagtgaactgcttgatctgcattatcaggaccttgaccttaatgaaggtagaataaatattcgccgactgaagaacggattttctaccgttcacccgttacgttttgatgagcgtgaagccgtggaacgctggacccaggaacgtgctaactggaaaggcgctgaccggactgacgctatatttatttctcgccgcgggagtcggctttctcgccagcaggcctatcgcattattcgcgatgccggtattgaagctggaaccgtaacgcagactcatcctcatatgttaaggcatgcttgcggttatgaattggcggagcgtggtgcagatactcgtttaattcaggattatctcgggcatcgaaatattcgccatactgtgcgttataccgccagtaatgctgctcgttttgccggattatgggaaagaaataatctcataaacgaaaaattaaaaagagaagaggtttgatttaacttattgataataaagttaaaaaaacaaataaatacaagacaattggggccaaactgtccatatcataaataagttacgtattttttctcaagcataaaaatattaaaaaacgacaaaaagcatctaactgtttgatatgtaaattatttctattgtaaattaatttcacatcacctccgctatatgtaaagctaacgtttctgtggctcgacgcatcttcctcattcttctctccaaaaaccacctcatgcaatataaacatctataaataaagataacaatagaatattaagccaacaaataaactgaaaaagtttgtccgcgatgctttcctctatgagtcaaaatggccccaaatgtttcatcttttgggggaaaactgtgcagtgttggcagtcaaactcgtttacaaaacaaagtgtacagaacgactgcccatgtcgatttagaaatagttttttgaaaggaaagcagcatgaaaattaaaactctggcaatcgttgttctgtcggctctgtccctcagttctacagcggctctggccgctgccacgacggttaatggtgggaccgttcactttaaaggggaagttgttaacgccgcttgcgcagttgatgcaggctctgttgatcaaaccgttcagttaggacaggttcgtaccgcatcgctggcacaggaaggagcaaccagttctgctgtcggttttaacattcagctgaatgattgcgataccaatgttgcatctaaagccgctgttgcctttttaggtacggcgattgatgcgggtcataccaacgttctggctctgcagagttcagctgcgggtagcgcaacaaacgttggtgtgcagatcctggacagaacgggtgctgcgctgacgctggatggtgcgacatttagttcagaaacaaccctgaataacggaaccaataccattccgttccaggcgcgttattttgcaaccggggccgcaaccccgggtgctgctaatgcggatgcgaccttcaaggttcagtatcaataacctacccaggttcagggacgtcattacgggcagggatgcccacccttgtgcgataaaaataacgatgaaaaggaagagattatttctattagcgtcgttgctgccaatgtttgctctggccggaaataaatggaataccacgttgcccggcggaaatatgcaatttcagggcgtcattattgcggaaacttgccggattgaagccggtgataaacaaatgacggtcaatatggggcaaatcagcagtaaccggtttcatgcggttggggaagatagcgcaccggtgccttttgttattcatttacgggaatgtagcacggtggtgagtgaacgtgtaggtgtggcgtttcacggtgtcgcggatggtaaaaatccggatgtgctttccgtgggagaggggccagggatagccaccaatattggcgtagcgttgtttgatgatgaaggaaacctcgtaccgattaatcgtcctccagcaaactggaaacggctttattcaggctctacttcgctacatttcatcgccaaatatcgtgctaccgggcgtcgggttactggcggcatcgccaatgcccaggcctggttctctttaacctatcagtaattgttcagcagataatgtgataacaggaacaggacagtgagtaataaaaacgtcaatgtaaggaaatcgcaggaaataacattctgcttgctggcaggtatcctgatgttcatggcaatgatggttgccggacgcgctgaagcgggagtggccttaggtgcgactcgcgtaatttatccggcagggcaaaaacaagagcaacttgccgtgacaaataatgatgaaaatagtacctatttaattcaatcatgggtggaaaatgccgatggtgtaaaggatggtcgttttatcgtgacgcctcctctgtttgcgatgaagggaaaaaaagagaataccttacgtattcttgatgcaacaaataaccaattgccacaggaccgggaaagtttattctggatgaacgttaaagcgattccgtcaatggataaatcaaaattgactgagaatacgctacagctcgcaattatcagccgcattaaactgtactatcgcccggctaaattagcgttgccacccgatcaggccgcagaaaaattaagatttcgtcgtagcgcgaattctctgacgctgattaacccgacaccctattacctgacggtaacagagttgaatgccggaacccgggttcttgaaaatgcattggtgcctccaatgggcgaaagcacggttaaattgccttctgatgcaggaagcaatattacttaccgaacaataaatgattatggcgcacttacccccaaaatgacgggcgtaatggaataacgcagggggaatttttcgcctgaataaaaagaattgactgccgggtgattttaagccggaggaataatgtcatatctgaatttaagactttaccagcgaaacacacaatgcttgcatattcgtaagcatcgtttggctggtttttttgtccgactcgttgtcgcctgtgcttttgccgcacaggcacctttgtcatctgccgacctctattttaatccgcgctttttagcggatgatccccaggctgtggccgatttatcgcgttttgaaaatgggcaagaattaccgccagggacgtatcgcgtcgatatctatttgaataatggttatatggcaacgcgtgatgtcacatttaatacgggcgacagtgaacaagggattgttccctgcctgacacgcgcgcaactcgccagtatggggctgaatacggcttctgtcgccggtatgaatctgctggcggatgatgcctgtgtgccattaaccacaatggtccaggacgctactgcgcatctggatgttggtcagcagcgactgaacctgacgatccctcaggcatttatgagtaatcgcgcgcgtggttatattcctcctgagttatgggatcccggtattaatgccggattgctcaattataatttcagcggaaatagtgtacagaatcggattgggggtaacagccattatgcatatttaaacctacagagtgggttaaatattggtgcgtggcgtttacgcgacaataccacctggagttataacagtagcgacagatcatcaggtagcaaaaataaatggcagcatatcaatacctggcttgagcgagacataataccgttacgttcccggctgacgctgggtgatggttatactcagggcgatattttcgatggtattaactttcgcggcgcacaattggcctcagatgacaatatgttacccgatagtcaaagaggatttgccccggtgatccacggtattgctcgtggtactgcacaggtcactattaaacaaaatgggtatgacatttataatagtacggtgccaccggggccttttaccatcaacgatatctatgccgcaggtaatagtggtgacttgcaggtaacgatcaaagaggctgacggcagcacgcagatttttaccgtaccctattcgtcagtcccgcttttgcaacgtgaagggcatactcgttattccattacggcaggagaataccgtagtggaaatgcgcagcaggaaaaaacccgctttttccagagtacattactccacggccttccggctggctggacaatatatggtggaacgcaactggcggatcgttatcgtgcttttaatttcggtatcgggaaaaacatgggggcactgggcgctctgtctgtggatatgacgcaggctaattccacacttcccgatgacagtcagcatgacggacaatcggtgcgttttctctataacaaatcgctcaatgaatcaggcacgaatattcagttagtgggttaccgttattcgaccagcggatattttaatttcgctgatacaacatacagtcgaatgaatggctacaacatcgaaacacaggacggagttattcaggttaagccgaaattcaccgactattacaacctcgcttataacaaacgcgggaaattacaactcaccgttactcagcaactcgggcgcacatcaacactgtatttgagtggtagccatcaaacttattggggaacgagtaatgtcgatgagcaattccaggctggattaaatactgcgttcgaagatatcaactggacgctcagctatagcctgacgaaaaacgcctggcaaaaaggacgggatcagatgttagcgcttaacgtcaatattcctttcagccactggctgcgttctgacagtaaatctcagtggcgacatgccagtgccagctacagcatgtcacacgatctcaacggtcggatgaccaatctggctggtgtatacggtacgttgctggaagacaacaacctcagctatagcgtgcaaaccggctatgccgggggaggcgatggaaatagcggaagtacaggctacgccacgctgaattatcgcggtggttacggcaatgccaatatcggttacagccatagcgatgatattaagcagctctattacggagtcagcggtggggtactggctcatgccaatggcgtaacgctggggcagccgttaaacgatacggtggtgcttgttaaagcgcctggcgcaaaagatgcaaaagtcgaaaaccagacgggggtgcgtaccgactggcgtggttatgccgtgctgccttatgccactgaatatcgggaaaatagagtggcgctggataccaataccctggctgataacgtcgatttagataacgcggttgctaacgttgttcccactcgtggggcgatcgtgcgagcagagtttaaagcgcgcgttgggataaaactgctcatgacgctgacccacaataataagccgctgccgtttggggcgatggtgacatcagagagtagccagagtagcggcattgttgcggataatggtcaggtttacctcagcggaatgcctttagcgggaaaagttcaggtgaaatggggagaagaggaaaatgctcactgtgtcgccaattatcaactgccaccagagagtcagcagcagttattaacccagctatcagctgaatgtcgttaagggggcgtgatgagaaacaaacctttttatcttctgtgcgcttttttgtggctggcggtgagtcacgctttggctgcggatagcacgattactatccgcggctatgtcagggataacggctgtagtgtggccgctgaatcaaccaattttactgttgatctgatggaaaacgcggcgaagcaatttaacaacattggcgcgacgactcctgttgttccatttcgtattttgctgtcaccctgtggtaatgccgtttctgccgtaaaggttgggtttactggcgttgcagatagccacaatgccaacctgcttgcacttgaaaatacggtgtcagcggcttcgggactgggaatacagcttctgaatgagcagcaaaatcaaataccccttaatgctccatcgtccgcgctttcgtggacgaccctgacgccgggtaaaccaaatacgctgaatttttacgcccggctaatggcgacacaggtgcctgtcactgcggggcatatcaatgccacggctaccttcactcttgaatatcagtaactggagatgctcatgaaatggtgcaaacgtgggtatgtattggcggcaatattggcgctcgcaagtgcgacgatacaggcagccgatgtcaccatcacggtgaacggtaaggtcgtcgccaaaccgtgtacggtttccaccaccaatgccacggttgatctcggcgatctttattctttcagtcttatgtctgccggggcggcatcggcctggcatgatgttgcgcttgagttgactaattgtccggtgggaacgtcgagggtcactgccagcttcagcggggcagccgacagtaccggatattataaaaaccaggggaccgcgcaaaacatccagttagagctacaggatgacagtggcaacacattgaatactggcgcaaccaaaacagttcaggtggatgattcctcacaatcagcgcacttcccgttacaggtcagagcattgacagtaaatggcggagccactcagggaaccattcaggcagtgattagcatcacctatacctacagctgaacccgaagagatgattgtaatgaaacgagttattaccctgtttgctgtactgctgatgggctggtcggtaaatgcctggtcattcgcctgtaaaaccgccaatggtaccgctatccctattggcggtggcagcgccaatgtttatgtaaaccttgcgcccgtcgtgaatgtggggcaaaacctggtcgtggatctttcgacgcaaatcttttgccataacgattatccggaaaccattacagactatgtcacactgcaacgaggctcggcttatggcggcgtgttatctaatttttccgggaccgtaaaatatagtggcagtagctatccatttcctaccaccagcgaaacgccgcgcgttgtttataattcgagaacggataagccgtggccggtggcgctttatttgacgcctgtgagcagtgcgggcggggtggcgattaaagctggctcattaattgccgtgcttattttgcgacagaccaacaactataacagcgatgatttccagtttgtgtggaatatttacgccaataatgatgtggtggtgcctactggcggctgcgatgtttctgctcgtgatgtcaccgttactctgccggactaccctggttcagtgccaattcctcttaccgtttattgtgcgaaaagccaaaacctggggtattacctctccggcacaaccgcagatgcgggcaactcgattttcaccaataccgcgtcgttttcacctgcacagggcgtcggcgtacagttgacgcgcaacggtacgattattccagcgaataacacggtatcgttaggagcagtagggacttcggcggtgagtctgggattaacggcaaattatgcacgtaccggagggcaggtgactgcagggaatgtgcaatcgattattggcgtgacttttgtttatcaataaagaaatcacaggacattgctaatgctggtacgcaatattacctgaagctaaaaacctgcacgttagccctttgtaggccagataagacgcgtcagcgtcgcatctggcataaacaaagcgcactttgctggtctgttcccctcaccctaaccctctccccggaggggcgaggggactgtccgggcacatttttagactttgtcatcagtctgagcctgccattggcaggctctggtgtccttttacgctaccatgctaataatcagcacaataatcagcccaaccacggagttgaccagctccagcagaccccaggttttcaacgtgtcttttactgacaggtcaaagtaacctttgaacaaccagaaagatgcatcgttaatgtgggtgagggtgttggaacccgcagccgtcgccagtaccagcagcgccggattcacgccaaccagctgaccagttgctggatctaggattgcagcactgataatcccggcggcggtcatcgccgaaacgacaccctgacccgtcgccagacgaattagcacagtgatcagccatgccatgatgtagggcgagatattgccgtgggacatcaacatgccgatggtgtcgccaatgccggtgtcgatgatggtctgcttcagcacgccacccgcaccgatgatcagaatcaccattgcaatactcttcaccgcgctttcaaaagcgttcatcacccactgcatgtcatgaccacgtgcggtgccaaagagtacgaatgcaaccaccatcgcaataaacattgcaatcggcgaggaaccgataaagttaaccacttcccaggcaggggtatcttttaccagccagatattggcgatggtggtagagatcataatgatcgccgggatcagcggcaccagaatcgaaacgccgaaagagggcagattattcatatctaccggttgatctgctttcaggaatgatggcgttgggcgctcaagattgccgaggaacttcggcaggatcagacctgcgcagattacacttgggatcgtcaccagtacgccatagatataaaccatccccatatccgcgccataagcattcaccagcgccaccggacccggctgcggtgggaacagtgaatgtgcggtagtggcagctgctactgccgggatcgccagtttcaggaacggaattttagcttcggcggcaataacaataaccagcggcgctaacatgataaaggccacttcatagaacatcgccagaccaaaaatcaggccgatgataatcaccgacagctgtacatagcgcagaccgagacgcgccagcagcgtatgcgctatctggtgagccgcgccggagtcgaccatcaatttaccgatgaccgcaccgaacaccacgatgatagccagttcccccagcgtgttgccgaagcccgctttcatagtgtgcagcagcgacatcaaatccatgcccgccagcatcccgacggacagcgccgccaccaacaaagccaccattgaattgattttgaacttcaaattcagtaccagcatcagaccaatgccgaataccacccagagaatgttaagcacatgcataacgttttaccttacctggttgaaccgttgttattttgggcgatatgttatgtaaattggtcaaccattgttgcgatgaatgtcacatcctctgatcaataaccatcgattaccctttgctgcaatttgcagcaacaaccatgagagtgaaattcttgtgatgtggttaaccaatttcagaattcgggttgacatgtcttaccaaaaggtagaacttatacgccatctcatccgatgcaacgccacggctgcggtctggttgttcatccggatacctaaacaactccagggttccgcgtctctttgctgtggaacccactatgtgaaagaggaaaaatcatggaacagacctggcgctggtacggcccaaacgatccggtttctttagctgatgtccgtcaggcgggcgcaactggcgtggttaccgcgctgcaccatatcccgaacggcgaagtatggtccgttgaagagatcctcaaacgcaaggcgatcattgaagacgcaggcctggtgtggtctgtcgtagaaagcgtgccaattcacgaagatatcaaaacccacactggcaactatgagcagtggatcgctaactatcagcagactctgcgcaacctggcgcagtgtggcattcgcaccgtgtgctacaacttcatgccggtgctcgactggacccgtactgacctcgaatacgtgctgccagacggctccaaagctctgcgcttcgaccagatcgaattcgctgcattcgaaatgcatatcctgaaacgcccaggcgcggaagcggattacaccgaagaagaaattgctcaggcagctgaacgcttcgccactatgagcgatgaagacaaagcgcgtctgacccgtaacatcattgctggtcttccgggcgcggaagaaggctacaccctcgaccagttccgtaaacacctggagctgtacaaagatatcgacaaagcgaagctgcgcgaaaactttgccgtcttcctgaaagcgattattccagttgctgaagaagtcggcgtgcgtatggctgttcacccggacgatccgccgcgcccgatcctcggcctgccgcgcattgtttccaccattgaagatatgcagtggatggttgataccgtaaacagcatggcaaacggttttaccatgtgcaccggttcctacggcgtgcgtgctgacaacgatctggttgatatgatcaagcagttcggtccgcgtatttacttcacccatctgcgctccaccatgcgtgaagataacccgaaaaccttccacgaagcggcgcacctgaacggtgacgttgatatgtacgaagtggtgaaagcgattgttgaagaagaacaccgtcgtaaagcggaaggcaaagaagacctgatcccgatgcgtccggaccacggtcatcagatgctggacgacctgaagaagaaaaccaacccaggttactccgcaattggtcgtctgaaaggcctggccgaagttcgcggtgtcgaactggcgatccagcgcgctttctttagccgttaatatccaccggcatggctgcgcgccgtgccggttccttcttccttgccgtcactctttgaagacggattctggagtttacgatgactactattgttgacagcaatctgccggttgcccgcccgtcatgggatcattctcgtctggaatcacgcattgtgcatctcggttgcggggcgtttcaccgcgcgcaccaggcgctgtatacccatcatctgctggaaagcaccgacagcgactggggcatctgcgaagttaacctgatgccaggcaacgaccgcgtgctgatcgaaaacctgaaaaaacagcaactgctgtacaccgtagcggaaaaaggcgcagagagcaccgagctgaaaattatcggttcgatgaaagaagcgctgcatccggaaatcgatggctgcgaaggtattctcaacgcgatggcgcgtccgcaaacggcgattgtctctctaacggtcacggaaaaaggctactgcgctgatgcggcaagcggtcaactggatctcaataacccgctgatcaagcacgatctggaaaacccgactgcgccgaagtccgcgattggttacatcgtcgaagcgttgcgtctgcgtcgtgaaaaagggttgaaagcgtttacggtgatgtcctgcgataacgtgcgtgaaaacggtcatgtggcgaaggtcgcggtactggggctggctcaggcgcgtgacccgcagctggcggcatggattgaagaaaatgtcaccttcccgtgcaccatggttgaccgcatcgttccggcggcgacgccagaaaccttacaggaaattgctgaccagctgggtgtttacgacccgtgcgccattgcctgcgaaccgttccgtcagtgggtgattgaagataacttcgttaatggtcgcccggattgggataaagtgggcgcacagttcgttgcagacgttgtgccgttcgaaatgatgaagctgcgtatgctgaacggcagccactcttttctggcgtacctcggttacctcggcggctatgaaaccattgccgacaccgtgactaacccggcttatcgcaaagcggcctttgccctgatgatgcaggaacaagcgccaacgctgtcgatgccggaaggtacagacctgaacgcctatgcgacgctgctgatcgagcgtttcagcaacccgtctctgcgtcaccgtacctggcagattgcgatggacggcagccagaagttaccgcagcgtctgctggacccggtgcgtctgcacctgcaaaacggcggcagctggcgtcacctggcgctgggcgtggctggctggatgcgttacacccagggcgtggatgagcagggtaatgccattgacgtggtcgacccgatgctggcggagttccagaagatcaacgcgcagtatcagggcgcagaccgcgtgaaagcgctgctgggcctgagcggtatttttgccgatgatctgccgcagaatgccgactttgttggcgcagtgacggcggcatatcagcagctgtgcgaacgcggtgcgcgcgagtgtgtggctgcgctgtaactaactgattaccctacagacttactggtcaatcaaactgatatttggttgaccagttttcgtttttttgcccacctgtacgtgccaacttccagtgctaatggtatagtttgagattaacgggggccgtaaaattgcccgttgtaggccggataaggcgttcacgccgcatccggcaaaaatttgattaaccgcacctaacggacacaacaccatgaaatctgccacctctgcgcaaagaccttaccaggaagtcggggcgatgatccgcgatctgatcataaagacgccgtacaatcctggcgaacggctgccgccggagcgtgaaattgcagaaatgcttgatgtcacgcggacggtggtacgtgaagcgctgatcatgctggagatcaaagggctggtggaagtacgccggggtgccggtatctatgttcttgataactcaggcagccagaacacagacagtccggatgccaacgtctgcaacgatgccggtccttttgagctgttacaggcgcggcagttattggagagcaacatcgccgagtttgccgctttgcaggctacccgcgaagatatcgtcaaaatgcgtcaggcattgcaactggaagagcgtgaactggcttccagtgcgccgggcagcagcgaaagcggtgacatgcagttccatctcgctattgccgaagcaacgcataacagcatgctggtggagctgttccgtcagtcctggcagtggcgggaaaacaatccaatgtggatccagttgcacagccatctggatgacagcctgtatcgcaaagagtggttgggcgatcacaaacagatcctcgccgcgttaatcaaaaaagatgcccgagcggcgaagctggcaatgtggcagcatctggaaaacgttaagcaacgtctgctggaattctcgaacgttgacgatatttattttgatggctatctgtttgattcatggccgctggataaagtcgacgcctgacttattataataagcgcaagggtaaacgttccttgcgctttcttaaattaagaagtcgcaatgagtattactttgtaaattgcagggtattgtttagctatctgtataacctgaatgttagtactcattcttcctggtagttatttaccaatataattccattcaccattttttaattcaaacagttctggaagagatgacggttgcagagtcatacgtttgagtggtgcattttcatcacccgggataactttatatcccatttttgcatggatctccgcggtaccgggataggcttctataccaattattgggtcattacccaactcaatattagcattaagtaatgcggcaagggcgaatccggaagaatttgctacccctgttaccgtcattatctgatcaatatagatatcaatccttggctgctcattggtccatctttttgcctgagaagctggaagggttgaaatatatcctatcgtggttccggcataaccaggaacattgcaaccagggcctaatgttatttcatgaactgtatagtcctcaacaggatcgaaagggctcttcataaataaatttagccgtaaaccttctgctaactctgtggtagcatgcgcctttttacatatgccaccatatatttcgtctaaagctgaggtgattttcaagttccgatagagcatacgtcctgttgttgtaataccatcggattctctgcatgctcctgtcacataattaaatggccaaggctctttactaatatcaagttttctaatttcgacaacgctttttccatcgtaattatggttattgccacgagtaagaggcggaagatagatgttttccgaatccatgcgtgcatattttaatttacgtgtaaactcactgtcgactattgggtgatgaaggaagtgagcatctgtaataatttgactctgaagggcattgcttaatggcatagacataatagttaccttttatgagtatttcactgatgtttagaaaaatagataaatttttctgtagtaaaaagagaagtaaacaaatgacatgcatgtttctgttgtagtgatatcaactctacacggtgatattaaagggtaggaaacactctaaagtatcaaaaaacgctcatttaaaattatttgcatgcaatttaaaagcatatcttattactaattggaatttgatgttgctatattgaggtctatattaataatgcctgtgaatggtatttttgatgtatttgatatgttatcaatttatattatttacaaactaattgtttcaaataatacatggctgattatgcggaaataaataatttcccaccggaattaagtagcagcggtgacaagtattttcatctacgtaactattcggaatattcagaatatactagcggtttttttttgagtttgatgatttttatcaaatcatgacttttttcctgaaaagtcagtagatattcataggcaagtaaggttttatactttgctgacaggattcaggcctgtctcagactgacatggatgtaatgaacaaaagggaatggctatggaaaatgagcatcaatacagtggtgcccggtgttcagggcaagccgcatatgttgctaaacgtcaggagtgcgcaaaatgatgcgacaatcacttcaggctgttttacctgaaatttcaggcaataaaacgtcatcgctgcgtaaatcggtatgcagcgatctcctcactctttttaattctcctcattcggcattaccgtcattacttgtttcaggcatgcccgagtggcaagtgcataacccgagcgacaaacatctccagagctggtattgccgtcagctgcgttctgcactgttatttcatgagccacggattgcggcgttgcaggttaatttgaaagaagcgtactgccacactctggcgatcagccttgagataatgctgtaccacgacgatgaaccgctaacgtttgatctggtctgggataatggcggttggcgcagtgcgacgctggagaatgtcagctaagcacaatctccagctcgcgcagttcacgccagaagcgttcggcaacgggattcatgcgggtattcatccggtatgcataggcctgaatcgggatcaccagttcgtcccgattcagtacaacgagcttcccgctgcgaatttcttgttggatggcgtactccggcagccaggcaatcccacagccgtcgagggcaacctgctttaaaagctcgctcatcgaagagacaaaaaaggtgctgaaacttaactcactgtggcgcgtcagggtgcgattaatcaatcgccccatgtaggagttgcggctgtaattcagtaacggaaagtgtggctgcgcgaggttaaaaagtgcttctccgtgttcgtcactggcgcagacagggaacaattgagattcaaataagcgaatgtggtcaaacggcgcttccagcaaatcttcgtcgtgaaaggaaaaaatacagtcactttgcccttcacgcagtttatcgaccgcttcatcgacatcaatagcttcaattgcccaggtaaagagcggcggcatctggctgataatggacggtaacagcccgagggaaagagagtgtgcagcggctatcttgatttttcgttgcgcgtaatcgctgccgccacgcagctctgccagattgctctctaactgttgcaacagatggcggatctgcgaatggaagattttcccttgttctgagagttgcagcggcgttacctggcggttaaacaattcaacaccaatcgcctgttccagcgcacggatgcggcggctgaatgccggttgcgagacgttgcgactgactgccgcctgggaaaaattgcggcatttttccagggtcagaaaatcataaagccatttggtttcaatattatgcaaaatcgcaccacagtcatccattacgttttactctgtcagccgcccttgcgggcattctacgtccattcgggcggctgacaaccgtttaagccgtttcaaacgttcctttcacgcaggctttgccgtctttgaccatcagtttgccgcgagcgtatacctgctcaatgcgcagttctggcgtcatgaccagcaagtcagcatcattgcctggcagaatttcgcctttcccggtcaggttaaggaaaccggctacgctactggtgagcgggcgcagggcatcgctgatactgaaatcatagtctttgaccagcacctgcacggtttccagcaacgtttcaaaaccggcaacaccgatatgggttaaattcccttcgtcatcgaagaacggctggctaccgttgccgtcggagctgagggtgacgcgtgccagcggaatacccgcctgaacggcgcgggcaataccttcggcaggggcgaccggttcgtcaatgctgctggtgatatcgatggtgccgcctttgcgcgcgaactccagcgcctgctcaaacaacggtacgttgcggttaacgtgggtcggcagcagcttgctgatcggcacatcgcagttttccagcaggtcataaataggctgtaacgcctttttactgtcgcccatgtggaacacggtgacgccaggtttaccgccgagcaaaccgccaacgcgggattctgccgccatattggccaggtgataaacgtccggtgcggcagaacggtgatcagagatggcgcatttcacgccaatcacacgatcgataatcgccacgtctttttccacggaacccgtaatggtgcgggaagggacatgataagcgccggtcagcatccaggcgctgatgccttcttcattgagcgcacgggtcttggcgagcagggattccgggtggcgagagatagagtcggtgcccagcagaccaaccactgacgtgacgcccgcttccgtcaggcgacttagcgccacttccggcgtgcgcgtcgtgggacctgcttcgccgccaccgccaatcaaatggacgtgttgatcaataaaacctgggcagaggatctgcccactgagatcgacaaccgtgcagttcggtacaatgtcagaagggatattgctggcaacggcgataattttgccgttagcgacgaggacatcgcaaattccccgatcttccggcgcatacaaatgcgctccctgcagcagggtaaaaccggctgcggtataatcaatcatggtaactccttgttaaacaataagctgcataacccagatcgacagcaatgcgttaatcacgcagaccgtaatgatatgcgggtaatatttggcattcacttcggctgtccccaggcagcgaccgacattttgcaccgggttgcccattaaatacatcgcgggcagtaaaacggtgacatcgtgaccggttaatgcgccagcggttgccagactggcggcaacaccgactgcgccacccatactcattaatgcggctaaaaggacggttgccgcttcaccgggtaatccccacagcgccattacgggttcacagatatgccccacccagtcgagcaggccggtaattttcagcgcctgaatgatgacaaacgccatcaccacgtttggcagcaggttggtcgtggcgatagtaaagccacggcgcgcgccatcgataaacatatccatgacgtttttgcggacctgagttgtcatgcttgcgctccttgcgttgggttgcgacgttcttcgaagttaagccagacgcgcaaaatgttggctccgacaaatttaaacaccaggatgacggctaaaggtacgattacggacgtgcccagaaaggcaaacaccgcgacgccggaagagaagtagttggtgatgatggcgctaccgctggtttgatatgcggcgaaaatcactttatcgcgttcggtaatttcaccttcctgcgccagctctttggtcataccggcggcggcatcggtgttttgcaggttagcgatcagcgccagcgagcagatccctggaatgcccaacaacggttttagcacaggtgtcattaactgctgcgcggcgcgtaatccaccaagaccatcggtaattgaaataatccccagagagagaatgactgacggtgccagctccagcgcaaagagaaagccatctttagcccccgcgccacccgcgccgcgaaatgaggtggtggctccgttcgcaccaggcagttgcccaaacgatccgttcagaacggaaaaatcaaaaacgcgccaccagctgtctgttccggaaaaaacaccggaaaaaaagattatggtgagaaaaaaggccagataccctttaatgcccactttttctgtcgccagctccccggctacagcatccccttgttgtgtcataacaatccccattgtttttttgtgtttgtgtgttgcttgagccaggaaaattcctggaactgaaaaaccttatcagccatgtgggtatggggaaaatgcaagtatgtttctggctatgcgttttttgcatagcggaaaaattacgctgtgtggaaaaggctctgcgcaggattgagttgcagaaaattcataaaccaagtgacaatgacatcagtaaataaaaacagaaaatccagggacgaaaacgagatggcaaagtacaacgaaaaagagctggcggatacgagcaagtttttaagttttgtcctccgacacaaaccggaggcgattggtatcgtactggaccgtgaaggatgggcggatatcgataagctcatactttgtgcccaaaaagcgggcaagcggttaacccgtgcattgctggatactgtggttgccaccagcgataaaaagcgttttagttattccagtgatggtaggtgcatccgcgcggttcaggggcattcgacttcgcaggtcgctatttcctttgccgaaaaaacaccgccacagtttctctaccacggtacggcaagccgtttccttgacgagataaaaaaacaggggctgattgcaggtgagcgtcactacgtacatctctctgctgatgaagcaacggcacgcaaagtgggagcaagacacggatcgccggttattttaaccgtcaaagcacaggaaatggcgaaacgaggcctccctttctggcaagcggaaaacggggtctggctgacatcaacggttgcggttgagtttcttgagtggtaagggaaacttccctcatgaagtgaccacttgtagcttaaataattgcactgtgctgataagcgcagcaataaacaacgccgccgcgccgcagagagtggcgctggcaagcgccgatgttccattgctgagcatactggtcagcgccgggccgaggatttgcccaatgccgtaaatgagcgtcacaaagcctaaaagattgagatttcccggtacgctcagttggcgggcgatagtcatcaccagagatgtcgtgcccataaaggtaccgccaaaaccaagactgctgatgataagcaagagaggcgagtcgctggcgagagtaagcagcacacagatagcctgcaccagcaaattcgccgtcaggcagggcaaagccccccaacgttttgctgcccatagccagccaaagcaaccaggcacaattgataagccgactaacgtccagagatgggcggttaacaatggtgagcctgcatctttcgccatgagcggcaggtaagtcgcgacgatgatataaccaaatcccgccaggccgtacagaatagccagtaaccaccagctcattatctgttgctccgtttttgccaatggcattggtgtgatggcgtgttttttcgagggcattaaaagcgtaagtgcaatcagcatcatgccagaaagcgccccggcgccttgccataacgtttgcgaggagaggtcaaaatgcaggcctgccagaacatattcattgcccagtgcgatgccaatgccaacgccagaaaacaaagctgccagcacaaaaggatggcgcgtgtgctgcataatcagcgtcgaaccaaaaatcagcataccggcgctggcgacacccgccaggacgcgaatcaataacaccagaataaatggcggcaaccatgccattgcgaggatcaacaacccgctcgccagggcagaagccaacagaaatgggcgcaggcgcgatggctggtgaaatgcgccaaaagaaaatagcagactgccagccagataccccgcatagttgccgctggcaatccacgagagctggctaaatgaaaacgatccttccgccatcatgacgggcaacataggcgtataaaggaagcggcctaaacccatacctaaggtcagaaccagcatcccgaaaagcgcggtgctgaaagaaaagcgttctacgggatgcgtggacgaaggcatgtttaaccttgtttgtcatttttgttgttaacaagttaataacaaaaaggtgaagcatgccagcctgttaatgcgatgattgaggggtaaagcgataaaaacgatttggttcgctaacgatataaatattaccagaggcatccatcgcaaccccttcggcctgtttgatgttatgcgacaaacctcgactgcctttggttagtgacatttcaccgataacctcgccaaccagggttacttcctggagtgcgcgagattcatgagacagcaccagaagcgtatttttttgctggttaaattctgcgccggacacatcatctaaagtaaattgccgttgtagtgcctcgtctttgctgatgtgtaattcattgctacttaacagcccgttaactttgtagacctcaatcggatttttctctttaaaaaaccagaaagtgtgatcctggcgagaataagccaacccttcaaaaccgcaattggttggggagtcttgcagcgggatttttatttttttgaggatttttacttccgagtttggggtcagtgaaatcacataaatggcgtaatcgcgctcatcgctaatgacaaactgattatcgccaatgtattcgatcgtctcgagatccttaacaaaatccagaggaattgtgcggataaaatcaccattggtggtcatttcaacaatggcggcaggtttgttgatagtgctaaaaagagtattgctttgtgccgaccaggtcagcgaagagatattattcgttatgcctgcaatttctttgccgtcaatggtggcgtggtaattctgaaatgatgctgcatgattgcttttacgggcgcaagattgcacgaagaaagtacacactgccacaatggcaaaaagaatcacaataatggagatgcgtttacttaacgaaatactttttgtcacggtaatccctttaaggcaaatcaataagatatcgagaagtatacgtagcgaccttaatgaatccttaacgcggagaaaccccgtaatgtgcaatgcagcgccagacaccatcctgctggcaataaattgactcagtcagcccagggatcacccattgtatttcctcgccggggggacaggtcagccaaatgcataacccgcagccgccgcgtaaatcacggggaatatcgctgacgcgaaaagtcatgcccgctgcctgcaacgctttgcgggtttgtatgacgccgaccgtggagtgaaataaaaataaaaactctttcatcggcgtgtcctcactcgttgaccaattaccgccgcgccaattgcgccagcaaattgcgcatcaggatgggtatttaccggcattcgcaggtgagattccagcatccgggcaaacttctggcaatgactaacgccaccagtaaacagaatcggcgcttcacaggagagacgagcaatgaaattggcactcctccgcgccatcgcgttaatcactcctgcgagaatcgcttctggcgcgacgcccgctgagcgcaggctgatcgcttctgattcagcaaacactgtgcacatactcgtgatggcgtgcggcgtgacattttcggtaatgctgtcgagttgctcgacgctggtgccaagcgtgcgcgagatcacctccaggaaacgcccggtgcccgccgcgcatttgtcattcatcaggaaatcgcacaggttaccgtcatcatcaagctgaatcactttgctgtcctgaccaccgatgtcgattaccgcgcgcgttgctggcgcaagaaaccgtgcgcccagcccgtgacaggagatttccgttacctgtttatcggcaaaatccaccagttgccgcccgtagccggtgagcgtcagaaacggcgttgtctctaacccttcgcgcagagtttcccaggcttcagtaattgctgttgccgggcgaaagggggttggaacgaggaaacggcgcgtaatcacgccgtctgccagtaagatccctttggtggcggttgagccggaatcaatgccaatcgaatatgccactgccactccttacagcatctcaataaaggccgcgacacgggtactgagctgcccgacatccgaggtggagtagtctgtttcaatagcgatataaggaatgttgtgctgctggcgcacatgacgtttaatcgccagcgattccaccgcgtaggtatggcacgcctgcaaaatcacatcaactacgccatcgacctgatattcctccaccatctggctgagcattttcaggcgctgatcgttcggcgaaacacaggagcagccaatcgccagatatttatccgccagcgcgtcgtagacatcgcccgtttctgccacgcattgctcggtcgctttcgccccggtgcagttttcataaccgacaacccagccgccattctcttcaatcgcgcgcaccactttttctgctgcgccgccaatcgggcagccggtgattaaaatgcgcggacgcgggtccagtcgctggccttcttcccactgctgacgaacgcgggcggtcattgcatccagttcattgatcaacgcctctttatcgaaccggaaggttgcgccgtaaaccactttcagaatgtcgctgccgctaagcgccggaggatttaactgcccaagatgataaaaattagccagtgcgcgacgttcgcggtttttcagcgcaatggcatcgcgcagagcatcttcgctaatctcgtgcccaaaacgttcttctaccgttttttgcaagcgcagcatctcggctttccataacgcacgcgaggcatcgtccttaacgctgttgggcaattgcatcacatgaacaggcttaaactccgccatgtattcatacattttctttttgccgtcgcaggtggtttcaccgaccaccagatccgaaaagtagaagtaggggcatttatcggttttgccgaagccgtagctgcttttaatcagcgggcagaggttgcgcggcagatctttctccgcttcttcaatggtttcatcagaggtggaacagagcgaaaccacaaccgcaccggctgccatcgggatctcttgcggcataaaggtgcagtaagtgccaaccagcggaatgccgcgctccttgagatccatgacggtgagaaagcctgtctggcgagcttcagagaactgatcgaaaatggcgggtagatcggtgacaagtgacatgattttccttccccgtaccacgggagataatgaaaagaggccacattattaccattcttttagtatggtttatttgatctctctcgcggttagccacttagtttttcatggatttctaaaaattgccgagggggaacaaggccgggagctgcgacagcaaatataaaattagcccaatacaaccgccaaccagcgtaccgttgacacgaataaactgcagatctttgccgatatttaactctatttgccgcgacatatcccgcgcatcccagctttttaccgtatcgctgatgtggcgcgtcaggaatgcggaaaactcaggcgcgacgcggtgcgcggcttgttcaagatgaccatttaacgacgcccgcaaggcatcatcggcaattaacgtttcgccaaaccattgacccgctcgtgcgatgcgttctttcacacgagaatcttcactgttgatatccactttcagccattcccgtaaatccccccacaattcactgagatagcgattaaaagcttcatcttctttcagatagctttttacggcatcggctcgcgctgccatttccggatcgtttttcagcttgtcgatcagggcgaaggtggcgcgatcaaacgcatggcggatctgatgcgcacgatcgcgactaatatcatcaagcaaagaattcaccgcgtcagaaaccaactccgcgctatgttcgcccaaccattcggtggggagaattttggctttcagtggatgctcgctctccagccagcgaacaatttgctgggcgataaacttgcgcgatttatcgcgctggagaagggcgatcaactgtgcgatcagcgtatccagcagcacctgatgacgatcgtttttggtcatactctccagcatcaacgcactggtgccggaaagatcgaccttatcaatcgcccgatggaccgcgcgcttaagcaggcgctgaatacgcgcatcatcggtaagttcgagaaaaccgctcatgatctgcaacagatgctgaccaacgcggcgggcgttttctggctggctaaaccagttgccaatcagcaacgccggttcgtggcgtcgaatcaatgccaccagggattgagtatcaagaaatttttcctgcacgaactggccgagattttcgccaatccggtctttattacgcgggataatcgccgtatggcgagaaatgatcggaatcggcacgcggcgaaacagcgccaccaccgcaaaccagtccgccagcgcgccgaccatcgccgcttcagcaatcgccttcacgccgctcacccaaaaattgggcggcaaaaacagcgtaacgacaaaggtagcagcggcgataagcagtaaagagagcgccaaccttttggcgcgtctgagttcgatgagtttattcataacgttaagaatagagcctgacggccggatcgcgcaaaaatcactgctcctccactagctcggctgcctgatgctggcgcacgcgattgagcaatcccgccagggtgaaaacgacgataacgcccgccacaacggctaacagatgaaacggcaagcgaccgccgttaaaccatagccagcggccgatttcgaccgagaccgacatcaccatcaggatcaccatatttagcgatgcggagacggtccctttcggtaacttattggaaaacagcgtaaagcggaataaggtcgggaaaatcaaaccaatcccgaaagcatacagactggtgcccagcaccgaccacagccagacgtgcggcgacagcagattgccgacaatcaacagcgagaggccgaccagttgaatgggtacggcacgccagataaaccgcggttcggtcggatctttaacaaaacgcgccacgatggcattcgcaacaatcaccgcgccgaacaccggaacctgtgtccaggcgaactgcgaagttgttaagctgcctgcatcgataaggatcaccggcgagacagccacccagctcatcatcgggatatagcttaaagagatggttgctgcgccaaagaggaacagccgattgcaaaagacattacgaaaatcgcgcaagacgcttttggcgctaaacggaaccgcgccgcgcttcaccgtctctggcatcgccaacagtaagccaacaaatgagataaaacccataaccgcaatgatggcaaaaaggactttccagtgcataaagtgcatcagagctgcgccggaaagcgggccgataatcggcgcaatcagtacgatggaggtgataatcgccatcaacttgatcccttttgtctgtccgaacgcctcctgcaccgtgacataaccaacggtggcaataaaacagatactggtgccctgaattgcacgcgcgataagaaactgtgtcatagacgttgtgaacattgtcgcggcgcaggcaagggtaaaaattagcgccccggtaatcagcaccggcctgcggccaattctgtcggaaagcggccccagcagccactgtaacgccataccgccagcaagatagagactgacggcagcaggggccagactgacatcggcattaaaatcacgtaccacattaatgatcccaggctggatcagatccgtcgacagatacgcagcaaagtcatacaaaatcaacgccatcgggaaaaacagcgtggcggcatggcgggtaaaaaaacgtggcataacaaacaactccttgtccggagaaccccaacggggaaaacgaaattcaataccgtcggtaatgacgaaaggcaggtgagaagggcaacgagactgcaaatgtactgaatttcatgtaatcaaccacactgcctgtgaacacacagacagagaaatactttctgacttcgggtcagaatgtataacgattacaaatagtcatcagcacattacacctcttgaattgatgggttgcatagaaaatatacaccttaagtgtaattaaaatttgcggttaatcaaaagagcgcggtggaaaggggaatatctgccgggtacaggacatgtaaaacgcgagcttgtttccggaaaaatgtatcgtttgcagaagaataaaaatagcctggaaagcgcctcggggaatgggaaattgccgggtgagaatggttttgttagtcgctaaagtcaggccatctttttcaacaggtgatggatcgccatgacaaacttcacgaccagcacgccgcatgatgcattatttaaaacctttctcacgcaccctgacactgcgcgggattttatggagattcacttacctaaagatttacgtgaactgtgcgatctcgatagcttaaaactggaatccgccagctttgtcgatgaaaaattgcgggcgctacactccgatattttatggtcggtaaagacccgcgaaggcgatggctatatctatgtggtgattgaacatcagagccgcgaggacattcatatggcctttcgcctgatgcgctattccatggcggtgatgtagcgccatatagagcatgataaacgccagccgctaccgttggtcatcccgatgctattttatcacggtagccgtagtccttacccctggtccctgtgctggctggacgaatttgccgacccgactaccgcacggaagctttataacgccgcgttcccgctggtggatgttactgtcgtgccagacgacgagattgtgcagcatcgcagagtcgccctgttggagttgatccaaaagcatattcgccagcgcgatctgatggggcttatcgatcaactggtagtattactggttacagagtgtgctaatgacagccagataactgcgctgttaaattacattttactgactggcgatgaagcgcgttttaatgagtttatcagtgaacttacccgtcgaatgccacaacacagggagcgaataatgacgattgcagagcgaattcataatgatggatatataaaaggggagcagcgcattcttcgattgttgttgcagaatggggcggatcctgaatggatacaaaagattaccggactttcggcagagcaaatgcaggcattaaggcagcccttgcctgagcgtgagcgctattcatggctcaagagctaatcagagacggatgacaaacgcaaagcagcctgatgcgctatgcttatcaggtctacataacccattaaatatattgaactttaaagatttttgtagacctggtcaggcgttcacatggcatccggcatgaacaaagcgtactttgcttaattcaggctggaacgtggcgatgacccagcaaagataaaacgagtcacaggttatgcatgagaggaaatcaggcgcttcgccgctatttcgaatttattccattgcccgatacacggcctcgccaatttgcttcagtgcttcgcgataggtttcgctgagcggcaaagcgcagttgatgcgcagacaattacggtatttgccggaagctgagaaaatcgagcctgccgccacctggattttcatgcggcacagctgccgcgcgacgcagaccatatcgacctgttcaggcaattctatccacagtaaaaatccgcctttcgggcgcgtaatacagatttcgcagggaaaatattcccgtatccagcaggtataaagcgccaaattgcgctgatagatctgccgcatccgccggatatggcgatgatagtgaccttccagcacaaacgttgccgccgccatttgcgtggacggcacattaaagctgctgatggcgtatttcatatgcatcagtttatcgtgataacgccccggtgcgacccaacccacgcgcaggcctggtgcaatacttttactgaacgagctgcacaacagcactcgcccgtcgatatcccaggaatgaatggtccgcgggcgcggatactccgtcgccagttcgccatagacatcatcttcaaaaatcacaatatcatgacgctgagcgagagagagaacggcccgtttgcgcgcgtccggcataataaatcccagcggattattacagtttggcaccagaatgatgcctttaatcggccactgttccagcgccagttccagcgcttcaacgctgatgccagtttctggatcggttgggatttcaatcactttcacgcccatgccgcgcagcatctgcatcgaaccgtaataacagggggattcgaccgcgacaatatcgcccggtttacacactgccattaacgccagcgacatcgagttatggcagccgctggtgatgatgatgtcatcggcggtgaccaccgagccgctgtcgagcatcaggcgggcaatctgctctcgcaatactcgctgaccggctaacaagtcataaccgagaacggtttgcagattatgctgcaccacccggcttagctcccgccacagcggtttcaggctgggcgcttcgacatccggtgtgcttttgcttaacggaacaatggaactgtcgctatgcgcctccagcatatccagcacctgatcccactgggtaatttccaccgggcgctgcaccggacgcgtcatcggcggtactggcggctgggctttacgttgtgcgacaaaataacccgaacgcggctgcggagtgatgagcttcatcgtctccagcgtctgatacgcctgctgcacggtgctgatactgacgccgtgctcctgacttaagctgcgcaccgacggcaatttctccccgtgacgatacagcccttgctcaatccgttcggcaagcagagtcgccagatgttgataacgcgtcatgctgtattccttatgtggaccatacagagagaaaaaccggtacagatgaggctaaaaaaccggatgcagatgctgttttaacctgtctgtatgttaaataaaagtaatatttgaatctgtattgtgaactgccagaaggtggatgatgaagcctctgaaagatgaggaggtagcagatggaatttcacgaaaacagagctaaagcgccgtttatcggcctggtgcaactctggcaggcggtgaggcgttggcggcggcaaatgcagacccgacgcgtgttacagcagatgagtgatgagcggttgaaggatatcgggttacgcagggaggatgtggagtgaggggggatatagatttatatataataaaacgtttttatgtttttaaattaagttataaaaattttcccgagacaattcatcaataggtatggagtgtacaggaatatcttcttcactaacctctttaaactcatgtcgataacggtcaaaaaacgcacagtgattacttgtgttttttgactgactttacaactctcattattcgctattgtgcagtttctctaattgttttataccctggaaagttaaatgtcagctactgaatactttttgattgtttgagatttattttcatttgaaattataaaatcaggtgataaatgagttgtgattaatagatggttgatatcatttttatctaaaattgatttatagtatcgacctgaaaaaatagttgttgccgcctgagtaactatacaatattctgaaaggttttctttcaaattagaaatgttgtggggttttgtttttgtatcttttatctctaaggagcttgctttgggtcaatcagaatacatttcatgggtaaaatgtacttcctggctaagtaactttgtgaatcttagagggttgagacaaccggatggccgtcctctttatgaatatcatgcaaccaatgatgaatatacccaattaacgcagctactccgtgcagtcggtcaatcacaatctaatatatgtaatagggactttgctgcctgttttgttcttttttgctctgagtggtaccgcagggattatgaacggcaatgcggatggacgtgggaccctatatataaaaaaatagggatttcattcaccgccacagagcttggtactatcgtaccgaaagggatggaagattactggctgcgcccaattcgattttatgaatctgaacgacgcaattttctcggaacattattcagtgaaggtggtttacctttccggctactcaaagaatcagacagtcgctttctggctgttttctccaggatccttggacaatatgagcaagcaaagcagtcaggtttttctgccctttcgctggcaagagctgtcatagaaaaatcagcgctgccaactgtttttagcgaagatacctctgtagaacttatcagtcatatggctgataacctcaattccttagtacttactcacaacctaataaatcacaaagaaccagtacaacagcttgagaaggttcaccctacctggcgaagcgagtttccaataccgttagatgatgaaacaggaacgcattttttgaatggactgctatgcgcagcctctgtagaggctaagcctcgactacaaaaaaataagagtacgcgttgccaattctattggtcagaaaagcatccagatgagcttagggtgatagtatctcttccggacgaagtttcctttcctgtaacaagcgagccgtcaactacgcgctttgaacttgccatttgtgaagatggtgaggaagtctctggccttgggccagcctatgcttctctggaaaacagacaggcaacagttcgattacgtaaaagcgaagtgagatttggcaggcaaaatccatcggcaggtttgtcgttagtggctcgtgctggagggatgattgttgggagcattaaacttgatgacagtgaaattgccattggtgaggtgccgttaaccttcatcgttgatgcagatcaatggctgttacagggacaggcttcttgcagtgtgcgaagcagcgatgttctgattgtgctccctcgggataatagcaatgttgctggttttgatggccaatcgagggcagtaaacgtattaggactaaaagcactacctgtgaagggatgtcaggacgttacagttacagcaaatgaaacttatcggattcgcaccggaagagaacaaatcagcatcggaaggtttgctctaaatggaaagcgtgcaagctgggtttgtcatccagatgaaacatttattggtgtaccaaaagtcatttctacactaccggatattcaaagcattgatgtaacgcgttacacgtgctgacaaaacagcattacagccagcaggaagtactgcgttggatcgatgtctgttcagggactcaacctaatgcaaaggatcccgcatttcttaaagtcagggcgcatatcttccagcgtaatacctagggaatatgggcttgtgttgataaagattgcagattaaagcacggtacaccgctcgacaaaggctggccctttggctatgtgtatgtgaaccagcgacaaaattgtgactgtggaagccctgtatacgaagttgcattctgtaatgattgtaatgagcctcatcttctggcacgggacaaaaagggcaaactagtccagtgggaaaataaaggtggcgatgaattctctttgcaggatgaagtacctgttgaacatgacgctacagaagaaaaagtcgaaaaagagaacagttttcagcctccgttgattattgccgcaggagagaccagcgaggcaggttataccctacaacgcctcgaccgtcagacgcgccgtattggcgttattaacaatgacagcattccgctgattattaatgatattgaacaggtttgtagtgccagtggctgtggctacagaggcatgagtgggaaacagcccttccggcgtgcactattaggtgggccattttacgttactaatatcgtgcccaccgttctagagtattgtcaggactttaccagtgatgaaggcaaagagggcgtcggaccagattcgttgccaggacgaggtcgtcgactcatcacctttacagacagtcgacaagggacagcccgaatggcggtgcgtatgcagcaagaagcagaacgcagtcgcttacgcggaagcgtagtcgaaattctcagctggcatcaaaggacgcaaacgtctacagcgccgaatgccaatgccgatctggaaaaattagcggccagggcgaagcaagcccgtgagcaggcagaagaatatcgaagctggggaatgccagaccaggcgaaattgtcacaagcacaggctgaacagcttgaacaggcttatcaggctgcaaccggtgggaaagccgcgactatcctggtatcccgaacctggacggagatggttaacgagcttaaagagagagccgatatccgcgggccggttctgcaatataaccattatcttaagcctgaagtgtttaatgaaaacggcggcccccttaagctttctgaaatgttgttgttccgggaattcatgcgtcgccctaaacggactaacagcctggaaacacaggggctggttcaggttggttaccaggggctggagaaaatacataagagccccttgcactggcaggaaaaaggattaacgctggatgactggcgcgattttctcaaggttacgttggatcattacgttcgcgagagcaacttcacacagctggatgatgagctgaaaaactggattggtagccgtttttcatcaaaattcgtccgtaacccggaatcaaaagatcctgaagataatcagaacagacgctggcctcaaattcgtaatggcaacgtatcccatcgtttagcgaagttgctgatgctgggggctggattcaaaaccgtcaatgcggcaactattgatattatcaatacatggctgaaagaagcatgggcccaacttaccggaccgcttgcagtactgaaacccgatggcaaccgtttttatttaccgaaagagcatatgactttttctttaatcacggatgcctggatttgcccggtaaccaataaaatcctggatacggcttttaaaggcttaaccccttatctgcctacccatatttcgttcgagcatcttaccctggcgcaatatgacacttttgtcgcgcagaaagtcacaatgccggaaatctggaagctggatcgttcacaggaagactacgcagagggtctggcaaaagcacgcgactgggtcagccatgatccgctgatcgcacaattgcggtcggaaaacgtctggacagacattaacgatcgtgtcgtggaaggcggcttctactatcgtactgccgagcactctgcccagcagtcgtcagaacgtctgcaaagctatgaaaagatgttcaagaatgggcaactaaatgttctcaactgttccaccaccatggaaatgggggttgataccgatcgcgtgatgacgctggcctctcgcagccagcaggcaacgattccggggccggagtggcacctgaatgacgaactggtggtgcgtagtctcggttataaaacggtagaactgaacgagtttattctgccggctaaagccaccaacgctgtcgagcgggtcaaagacattcagatccacaaacagttgaatggaccactgtcgcagtttgggcaacgcttctgggacgtgctgtttaacgaccatgaagaagcgcagtcactgatgaataacacgcgaattaccggcgttcactataccgatcgctatctgcaaaacccggttgcgctggcgttgttgggatcaattctgagaccgctaaaaacaaagctgaccgatggcgctgaagtgacgctggatacgctatttaaagataaagatcgccccggtaaccggcctttccatgactggatgagcatagcggattttcaggatttcgctgatcagtggtttgctgctgcgctgggcaggccggtagaactgacggtgttcgactcgccgcgcgatatccctcaccatcgtaaactgacggtgacttttgaggatggtcaggtattgaagatccgcttcgatcaggggatgggctactggcgcatcaacttttcatcgcaatggcattactttgatttccgcgatgacgtttctttccagttagtcaaaatggctcaggcctgcaaggaagggaatgtcgccaacagcgaagagagttgggcaacggatgtgctggtggaggtgatcgcctcctgatgatgagccgctcccgatgtggtgtcgggagcggtattttctataaaacttaccgcttatttgagatattcatcgaaaatgtcgagtaattcttgatgtatacacggccattcctgacctaaattgacggtacacaagccaatatcgaagccattaattttataacgatgtttcactgcggtatctacgtggggatatattaataacccccctatgttttcgccattttcaggctttaacgaccataagtaattcatcagttgataaagattttgcgaatgaaatttttctgttcccattcgtcgtgaaaaaatgctcttatagtatttggcgtcaacgataagtattttttctgatgagcgaatggtgatgtcagtttccattcgaggtaacaaattaagtgactgatccgatatactcgatgcatcccattttaaataagagcgggttgtgtttgcagacgttaattcacgacggcaaaattcataaagaaacttttgataaagtaatgacatctctttttcgtttctttcaaaatcatagaaacggtagtgtcctttgttttgacctggaatagaattattgacgatgaatttgcagacactgataacgaatttataataacgcgtattttttccgccattcagatagctgaaatgctgcggagttaaatgaagagtgctaatgcccggtaattttctataaagtgaacgagcttcatctctgatagttgaatttaacttttcatgcttaattaatatggctaatgtgctttttataattcggttagccagcgtgtcttcattaagcatatcaaaagtactgacggttttcccatgattaagatggaagccgcgtattgttttagcaaactctattcgccctttgatgccaggaatgatctcggtgttaggattgtaatcaagctcaagccctcggcgtgaaagctgtaaaacccctttatttaatacataccccaggatatcaagaagattgttaccgggtatggcttcaaggtttgcctgcttaatttcctgtaaataaccccatgcataggtaagcatgtaatagatattacggacaggtatcacgggctgttccactatgagtcccctaataatttgttggtccatttctgttgtttataggggtcatcaaagaaatattcttcgagtaaaggggcgatatccgtcatcacaatttcattaagccattgcgtatccggagaggtgccatcttccaacccacagcagaagtaactatgcccaatgcggaatcctttcccaaggatagtggcctctttgctgatttcctggttcaactcgttcattttttggcataaagactcaacaaatgaaggttctgcttttttattcagtaaaaaattccggaactgtggtgtatcaaaacctggctcaatatctatgaaagaaaatcgtctgcgtagggcatagtcaacaacggccagagagcgatcggcagtattcattaaaccgatgatataaacattctccgggacatagaatcgttcttcatcgttttcggagtaggttaggggaacagaccagttttcacctcgtttatcatgttccattaacatcatcacttcgccaaatactttactgagattggcacgattgatttcatctataataaaaatatactttttctctggctgctctttagcttgctgacaaaaattgtaaaatatgccgtctttacgtcggaagccgacgccattcggacgatagccctgtataaaatcctcatagctataagattgatggaactgaaccatattgacgcgttgcggagccttttctcctgtcagcaagtaagccagacggcgtgcaacaaaggtttttccaacgccgggcggcccctggaggataatattttttttgatggttaatcgtttgagtatcgtctctattgtggtttcagggataaacaaatcatttaacgcatcttccagacagtatgattcagtttttgacataggtggaataacactcttgccagaattaaatattaatttatagtcgttgattatgttgtccagcatagaggcaaatcgggtgtaatcaataccctgtgagactttttgggaacaggcgtaataggactgtccgtattttttaggatatacacccgaagttgcctgaaaatactctgcgattgttttaggtatgtctgaagagaactgccattgggcatgtggttcattcgtgtcgcttataccataagccaaaaccaactcatcaaaatctttataatagagaataacgggatatataccgttagaagcttcctgaccttctccaagaaatgcaaaccagggaatagacgtaaaattaccataaccgaaactcaattttactcgcaggttacggtaagacgttggataatctttagtggattgcgaacgttgttgctgtgcttgcttaataaatttttcaatccagggttgaatagattccataagatatgccttcctcattgctaagcctctattatcgctttcgcaacgtactgaaacaatagatttttactgcaaaatcagactggtaaatatttactgagggggaaagtttctattgagtcagtggaaggctcccggtggttaaccgggagtaaacgctgttacgcgactttctgtttaccggcaatcactccaataaacgcctgcacctgcttttgtttacgcgccgacagtttgcacacctggcgtagcgactgcatcagttcgctctcctcggcggcgggtggttgggcggtgaggacaatacagccttccatcactttgacatctaccgccgtgccagtggcaaaaccggcggcttccagccactgacctttcagggtgatggcgggaatacggctgtaatccgggtagcgactcgcataaccgacggtgacatgacggttatttgccggggagacttctgcttcgaacggttgtgcaatagaatgcgtgtcagtcataactgctattctccaggaatagtgattgtgattagcgatgcgggtgtgttggcgcacatccgcaccgcgctaaatacctgtatatatcatcagtaaatatggggaaagtccagctaaaaatagaataaaatgggcaatttctggaatgatttaaatatatttatgtgggttatgattggcgtgaaataataaaaagcgcaccggaaaggtgcgccagaaaataatgttcaggattttttacgtgaggcttttttacccccgctagctgcgcgttcagctttgattttttccagcaacgcggcggcgctgttttctccgctgatcaaatccgggttttcggcccgccactgggcggtaagttcaccacggaacgcttttgccaggatggattgcgtcaggttgttgacgcgggctaaggcgttgttgacctgtttttctatggtgtcggcgtaggcgaagagttgctcgacgcggcgaacgatttcggcttgttcttttactggaggtaataaaacaacttgggatttgatatcttttcctgaaatacctttttgaccagaagttgttttcacgcagttcatcattgcatttcgtgctgagggggatgaaaaaaatatttcgatatattctggtaaagcatctttggttaatcgagctcgaataagtttatcaggatatagcaaattttgatgttgtaattttttcaataacccacaaacaccaacaaattctaaacttccgttatagcgagtaaataaaagatctccatcttgtaatttgtggcggtttagttcactttctgaacattctagaaaccgaatatcgttttgatctacatggccagcacgtacagaactaatgcgtagtattggatgaccaacaccactttcatttggctttgatgaaagaccattacgtaattcagttaagatagattcaaaatttaacttcttaaatacagaatgttgcggctcaaaattacgccatttttctgtcaattttccattaactgcgccccccaataccgcttgacgaaaacgtttcaggatttgtgggatttgctcaaaacgtgctttggtgctgtctacctgcgccagcagcgtatcgagtttttcagcgatgattttttgttcggcaagtggtgggattggtatatttatcaaatcaaagcttgccggcttaatattattaatatttgcaccagcagaaagtgatgaaattttgtttcgataaagagaagattttgtgaaatgagcaataaaaccagaaaatataagtttttcaggacgtaatacaccgcaaaatgcgccgaaactacattcaaatggtagatgctgatgtgcggatttaccaactacggatttgctccctgatgacattgcaataacaatatcttcaggagatattttttgactttctttaacaagatttttaggaacaaaaaccaagtccgtagtatcaaacttgccattctgaatattgttcgcacggataagaggcaaataatcatcttttagataatttattgcctgctcttttttatacgttactcctcggattagagttgtgaccgtagatactggggcgataacccacccctccggcaatttccccgcactcattccttcaccccaccaaacgcttcttccagcaactgacgctgcaaatcggcctcatcgctcgcccccagttcacgcatcagcgcatccagttcagacagcgcctgtaccagttcgcccatcgcttctgccgctaatacatccggctccggcaggctgtcggcatcaatactgtctttatctttcagccaggagatatccagcgaatcggattttgcggtgcggatccactcacggctgaacttgcgccagcggctggtagcaagatgctggtcggtgtttttgttctcttcgctgtcggcaacttccgtctcttcggcgttaaaactccattcaccttcagtgcgcgggcttaaaccgtgcgggtcttcgccatacacgcgctcaaacggctgcaaatgctcgtcggtaaacggtgtgcgcttgccgaaactcggcatattggtacgcaggtcatacacccacacatcatcggtacagttcttatcctgattcgggttcgccaccgtccctttggtaaagaacagcacgttggtcttcacgccctgagcgtaaaaaataccggtcggcagacgcagaatggtgtgcagatgacacttatccatcaggtcacgacgaatgtcggtgcctttgccgccttcaaacagcacgttatccggcaccaccaccgccgcacgaccgccgggatgcagcgtttcgataatatgctgcataaagcacaactgtttgttgctggtcgggtgaacaaaggtgcgggtaatgttggtgcctgcggcgctgccaaacggcgggttagtggcgacaatatgcgccttcggcaggttttcaccgtcgctacccagagtgttgcccagacggattgcgccgccgtggtcgaggttgccttcaatatcgtgcagcaggcagttcatcagtgccagacgacgggtgccgggcaccagttcgaggccgataaacgcgcggtggatctggaaatcctgcgtgtcgccatcaaggtcgtccagatcattggtttgcgacttaacatagcggtcggcttcaatcaaaaagcccgccgtacctgccgccgggtcctgcaccacttcacgcggctgcggtttcagcagatgaataatggttttaatcagcggacgcggggtgaagtactggcctgcaccagacttggtttcattcgcgttcttctgcaacagcccttcgtacatatcgccgaagtcatcgcgcgacttaccgtgcgcgccgttgtaccagtccagcgaatccatattgctgaccagtgcggttatttgtttcggctcggtgatggtggtactaacattatgaaaaactgcctgtaccagctttttgtcatcttcgcctaaatgcacgagcatttttcggtagaactgcaactgctcctggccgatgcgggatttcaggtcatcccagcggtaaccttccggcaggtattccgcttcctgaccggtctctttacacattttcaaaaacagcagcgaggcgagttcattgacgtagttttgataggaaacgccgccatcgcgcaggttgtcgcacagcttccacagcttcgcgaccagatcgttattgttcattgtgagttccgtaaattaagcagcggcccaaattcatcgagccgcagaagaagaaattgccgagggtaatatacacaaaatcattcaggttgcatcaaggcggcaagtgagtgaatccccgggagcgtacagaagtacgtgaccggggtgaacgagcgcagccaacgcagaggcagcctgaaggatgaagtgtatacgtgtcaggccagctcgtcccagatataatcgctgaatttgcccagcagggtatcgagattatcgtcaaaggttctttgcagcatcgccttcccgccgcgacggtggaagttgccggttttgaagacatcgtcgtcgagcaccactttctctttcagcgcctgcgctaaacgatcgagccagcttaattgctcgctgctccagtcgttttcgcccttaatgcgcgtcagcgcgtgatcgacacgttcctcaaacggtttcagcgcatcgcccaccgcagcgcggcgaatatgaccaatcagccgggcggcgatatcttcattgcgcgtctctttccatgctttgcgcagggaagattcctcaaagtgctggcggtcaaaccactcctgtagctcgaccagccctttacgggtgagatcgcgcgggcgattaataactgcctgcaatgccggttgcgcgttcggggaacgttgcaccagcgagtcaaaggcttcgaggaaatcctgcggcgtgtcgtaatcaccgtacagcgattttacactcaccacttcatcgtcgatatcgaggaagatcggcgcatcattcaggttgttgatgtccgttttcagcttttccagacgggcgataaagccaggcagtttgttaaagacttcggcgctccagtgcggccctttttcccgcaggcgcgaggcgaagccgttaaagttcacgcccgccgcgtcctggcatagctcatccagacgacgcacctgtttatctatcgtttcgctgcggtcacggttaaacgtggccagaccgatgatacgctggagcttcgccaccagttgttcatggctgtgctcggcaaaactgcggccatccgcttcggtgattttataggtttctgaatcggtaatttcattgaccagcgtttgcagttccaccttcgggcgcaccaccaccggacgcatggtgtcgacgctctccagcgtgctgtagatatcgacacagtcaaaaatcttaaagctggttttattcacctccgggcataagcgcgtggcgcggcctttcatctgttcgtacagaatgcggctgcgtactttacgcaggaacacgatattacagatcgacggaatatcgacgccggtcgtcagcaggtcgacggttaccacgatattgggcagccgctctttattgaagcgggtgatcatggtctgcactttgcgcgcgtctttatcggcatcaccggtgatcttgatgatcgcgtcgtgctccagttgcggatactttttcttgaacgcggcacgcagctcttccaccaccatatcggcatgggcattggtgacgcagaagaccagcgttttttgcgatccggtcgggtcaagataattggtgagttcgttacagacggcgcggttaaacgccgggatcaccaggccacggttaaagtcggcgacttcaaaatcctgatcgtcttccagggtgtcattgatcacttctccctgcgggctgatgcgctctacctgctcgcctttggagagataaaccccctcctgcgcgttgcgggtgatgatctgaataggcggatcctggtcgatcagaaaaccgtcgataaccgcggtacggtaggtataacggtaaaccggctcgccgaaaatctgcacagtatgtagcgccggggtggcggtgagagcgatttttaccgcatcgaagtgatcgagaatgcgacggtaggcagagacgtaatccagctggctgcggaactgcagttcgccttcggtctgctctttatcgagaatatagccgcgatgcgcttcgtcaacgacgatacagtcgtaacgggccaccggcatcggttcatctgattgcagggtgcgtttcaccagcgactgtacggtggcaacgtgaattttggtgctgtcttccgggaatttatccgtcagccctttaatgtcgaaaatgctgttgaaggtgtcgccgttaatacgcgtatcttcaaacgcgcccagcgcctgttcgccaagagaacggcggtcgacaaggaagagaatgcgtttaaaacgctgggactggatcaggcggaacatcatggcgattgccgtacgggttttaccggtaccggtcgccatcgccagcaggatctcttgttgccccttgacgattgccttttcaaccgcgcggacggcatcttcctgataataacgcaggcccagctcgctcatgccagggttatcggcaaaccactgattctgtttttgcggttcgctgccgagcatttccagcagctcttccgggcggtgccactcgggtaaggctttcgacatattgcgggtatcacgcacgtcgcgataccagatgccgcttttggtcttcattgttgcgcggtattcgcgcccgttggtcgagtagcagaaggggattttaaaccgttgtttgccgctggtgtcctgccagctggtttcatactctggcactgcttcatgcacttcatccggtgagtagtgctcaagcaaggtttcccgcaggaagccattatcgaaacatttactgtagcgatacgactcattgagcctggcgggaacgtcgatattgttacgtttcgcctctaccaccgcgatgggtttgaggccgacaaacagcacataatccgcaaagccctgattacccgtttcatcttttccggtcggccattcggcaatggctttattgacgccgggttccggacgtgcgcctttggagaagcgcagggttttgctgtcggcctgccagcctgctttacgcagttgcgcatcaatcaggaagcgactctcttcttcgctaaggttgagtgtgcgcttgatggcctgatcggtaatttctttgtggtaagccttacgttcctgttcggtctgttttgccagttccgcgttcttctcggcgagctgtgcttccagtgccgcaaggcgagcctgggtttgcgcttcggtttcctgctgtttgccttccagaatggcgatatagccgttcagggcaaccagcttctgctgttgcgcttcgacttctgcctgagtctgcgctttttctcgcacctgctgttcaagctgttgttttagcgtcagcacttcctggtgatagaggttttcaccacgttccggcaacacaaacaccggcaccgggaagtcataatctttagtgaccagacggtagtaccagacagccaggcggaacccgagtcgcaggcacatctgggcatcgttgagatcgttatgatattcgtgcaccgcctggttaccaatgcggcgtaatttgtgaaatacagagaggatgttgtcatcaacaaaggcgattttgccgagttcacgcaggagatcgtgttgattctcacaaggggggatgttgagtaacagaccaagatgtttcgctgtggcttcgccaaacatacgcattttaatcagcgtcgtgttgggatcatccgggtagttattttccgccgcacaggcgatggcataagtgaagtcgttgacgcccttcaggaattcaaaattggatttattcatcattgttattaatccattgctgtgcgggcctgtccaaatatttaaggcccataacatctcatcttagctttctgtacctttccgggcaatgaccacggtcacagcaactgactcatttctaacgtgttcgtctatttttgtagtgctatagtagccgaaaaacatctacctgattctgcaaggatgtactatgacggttcctacctatgacaaatttattgaacctgttctgcgttatctggcaacaaaaccggaaggtgcagccgcgcgtgatgttcatgaggctgccgcggatgcattaggactggatgacagccagcgagcgaaagtcattaccagcggacaacttgtttataaaaatcgtgcaggctgggcgcatgaccgtttaaaacgtgccgggttgtcgcaaagtttgtcgcgtggcaaatggtgcctgactcctgcgggttttgactgggttgcgtctcatccccagccaatgacggagcaggagacgaaccatctggccttcgcttttgtgaatgtcaaacttaagtcacggccggatgccgtcgatttagatccgaaagccgactctcccgatcatgaagaacttgcaaagagcagcccggacgatcggttagatcaggcgctaaaagagcttcgtgatgcggtggctgatgaggttctggaaaacttattgcaggtttctccttcgcgctttgaagtcattgttctggatgttttgcatcgcctggggtatggcggccaccgtgatgatttgcagcgtgttggcggtactggagatggtggcatcgatggtgtgatatcgcttgataaacttggcctggagaaagtttatgttcaggcaaaacgttggcagaatactgtaggcaggccagaattacaggcattttacggcgcactggctgggcaaaaagcgaaacgtggggtgtttattaccacttctggatttacttctcaggcgcgtgactttgcccaatccgtcgagggtatggtgttggttgatggggaacgcctggtgcacttaatgatcgaaaacgaagtaggggtttcttcacgtttgttgaaggtgccgaaactggatatggactattttgagtgaaatatcaggccggatgcggctgcgccttatccggcccataaccccttacttcctcaaccccgcaaacgcagcccgaatctcttcctccggcagctggatcccgataaacaccatcgtgctatgcggtttttcatcgccccacggcctgtcccagtcggcgctgtagaggcgctggacgccctggaacagcaggcggttaggttcgccgtcaatccacagcatccctttgtaacgtagcagtttatccgccgactccagcagcaggttttccatcacgcgggaaacttcgctgatatctaccgggtaatccagttccaccacaatcgacgaaatatcgttttgtttatctgcgataaagtggaaacgcggtttggtgctgacgacgttttcttccagcataaaaccgttggtgttgaacagcaggcccagatcgatgtcgccgtgggtgacggtgtagaccggtgcgcgggcgttgatgcgcgccaggcgttcatgcagtttttctgcttcgcctgcgacgtcggttttggtcagcagaatgcggtcggcgtagccaacctgtgactgggcgatggtgaactggttcatctgctcatcggcatgtaccgcatccaccagcgcaatcacgccgtccagcagataacgctggcataaaacttcatgggagaaaaaggtctgaataatcgggccgggatcggccatgccggtgcattcaatgaccagacggtcgaactgaatattgcccttgtcgagattgtccagcaggtcgagtagcgcgtcctccagctcgttggagcgcgaacaacagatgcagccgttggtcagcgttttgatctgcgtggcgcggtcgccaatcagttgatcatcaacagagacttcgccgaattcgttttcaatcacggcaatcttgtagccgtgctgttcgttaagaatatggcgcagcagggtggtttttcctgcgcctaaaaaaccggtgagtagggtaactgcaatcgggttcatgctctctccattaacaacagcgcataccgcctttaccatcgccgccgtagcgcgcgttctggcgttcgcggaagaattcttcatagctcatgtacggcttgtcgggatggttggtcttcatatgctcgacgtagttgtcgtagtctggaatgccaatcaacatcttcgccgcctggccgagatatttttttgcctgtcctaagttaccaaacatagttcactctgataagaacaaagccccgccgaagcggggctaaacacggttagtggtgcgaagagatcttcacgccgccttccgggattggaacgtacggtgtttctttgtcagtacgtttgtcgctgttacgcaccgcaagccaggttttgaaaccgtagaagatgatgctgtacaccacaatcaggaacagaatactcagacctgcgttggtgtagttgttcacaacgatgtggttcatattggcaatctgctgcgccgtcaggtcagtaccgttagcaatcttctctttgtactggcttgccatgtagaagaagccttccatctgcgggttggtgctgaacagtttcaggcccagcgcccaggtggtgcagataagcagccatacagccggaacaacagttacccagatgtattgggtgcgcttcatcttaatcagcacaacggtgcccagtaccagcgctacggctgccagcatctggttggagataccgaacagcggccacaggctcttaacgccgcccagcggatcaaccacgccctgatacagcaggtagccccacagacccacacagcccgcagtaccgatgataccggcaaccagagaatcggtttttttcaggaacgggatgaagttacccagcaggtcttgcagcataaagcggccagaacgggtacccgcatccagcgcggtcaggatgaacagggcttcgaacagaataccgaagtgataccagaagcccatgtcagccatcggcagcactttgtggaacacgtgcgcgatacctaccgccagcgtcggcgcgccacctgcacggttcaggacagaaggctcaccaatgtctttcgcggtttgcaggatctgctctggcgaaatcacgaagccccaggagctgacggtcgctgccgcgtgtgcggtaacgtctttcagctgcgccatgatgatcggcgcgttctcgccacccatttcatgcaggttaggcatggtgatgccaaggccagcaggcggggtgttcatcgcgaagtaaagacccggttcgatgatggacgcagcaaccagcgccataatcgccacgaaggactccatcagcattgcgccgtagccgatgaaacgcgcgtcggtttcattagccagcagttttggcgtcgtaccggaagagatcagcgcgtggaagccagataccgcaccacaggcgatggtgatgaacaggaacgggaacagagcgcctttccacagcgggccagtaccgtcaatgtactgggtcatggcaggcattttcagttccgggttcagcaccacgatacccagcgccaggccgacgataacgccgattttcaggaaggttgccagatagtcgcgcggtgcgaggatcagccacactggcagcagtgcggaaacaaacgcatagccaatcagcgcgaaggtaatggtggtgtctttaaaggtcagtgccggaccccagtacggatcgtgagcaatcacgccaccgaagtagatagaggcaaccagcagcacgataccaatgacagagacttcacccacacgccccggacgaataaagcgcatgtagatacccataaacagcgcaatcggtacggttgagcaaacggtgaagacaccccacggactttcggccagggctttaaccacaatcagcgccaggacggcgaggatgatgatcatgattaagaaacagccaaacagcgcgatagtccccggtactggtcccatctcttctttgatcatctcaccaagagatgcgccattacggcgagaggagataaacagcaccataaagtcctgaaccgcaccggccagcacgacccccgccagcagccacagcgtgccaggcaggtagcccatctgcgcggcgagaaccggacccaccagcggaccagcaccggcgatagcggcgaagtggtgaccaaacaacacgtaacggttggtcggaacgtagttcagaccgtcgttgttaataaccgcaggcgtcgcgcgcgtggggtcgagtttcatcaccttctgggcgatgtacagactgtagtagcgatacgccaccagatacaccgatacagaggcgaccacgatccacagggcgctgatgtgctccccccgacgtaatgcaactaccgcgaggcagaatgcaccgatgattccgagaatcacccagggtatgtgcttgaatatctttttagtatccatagtaaaacctggcatgtattgattaatagttggccgaagccgttctaggtttgcgttgcgtttgaggaggtaaattgaccgctatcctgtagtgatgttgccagagttacgcgcgcgtaaagtaaggtaaataactgagtggttattttagggatgtaagcggtcagttttgcggttgagcggcaaaggcgtcgtttaagtgacgataaatatgtgattcatatcacatatttatattgtgaataatttatgtaaataatggctttttaaattcagagtgtgaataaaattcactcggcgtaatctccgcgggatattcataaagtttttcctttccaggccgaaaatcttgcatcggtccacaggaaagagaaaccatgttaaaacgtatcaaaattgtgaccagcttactgctggttttggccgtttttggccttttacaactgacatcaggcggtctgttctttaatgccttaaagaatgacaaagaaaatttcactgttttacaaaccattcgccagcagcaatccacgctgaatggcagctgggtcgcgttgttgcagacgcgtaacaccctcaaccgcgcgggtatccgctacatgatggatcagaataatattggtagcggttcaaccgttgctgagctgatggagagtgccagtatttcgctgaaacaggcggaaaaaaactgggcggattacgaagcgttgccgcgtgacccgcgtcagagcaccgccgcagcggcagagatcaaacgtaattacgatatttatcacaatgcgctggcggagctgatccaactgttaggtgcaggcaaaatcaacgagttctttgatcagccgacccagggatatcaggacggtttcgagaagcagtatgtggcttacatggagcaaaacgatcggctccatgatatcgccgtcagcgataacaatgcctcctacagccaggcgatgtggattctggtgggcgtgatgatcgtcgtactggcggtcatcttcgccgtctggttcggtattaaagcctcgctggtagcgccaatgaatcgcctgattgacagcattcgtcatattgcaggcggcgatctggtgaaaccgattgaggtggatggctctaatgagatggggcaactggcagagagtttgcgccatatgcagggagagctgatgcgtaccgtcggtgatgtgcgcaacggggccaatgccatctatagcggtgccagcgaaatcgccaccggcaataacgatctctcttcgcgcaccgagcaacaggccgcttcgctggaagagacggcagccagcatggagcaactgaccgcaacggtgaagcagaacgccgaaaatgcgcgccaggccagccatctggcgttaagtgcttctgaaacggcgcaacgcggcggtaaagtggtagataacgtggtgcagactatgcgcgatatctccaccagttcgcagaaaatcgccgatattatcagcgtaattgacggcattgccttccagaccaatattctggctttgaacgcggcggttgaggctgcgcgtgcgggtgagcaagggcgcggttttgcggtggtcgcgggagaagtgcgtaatctggcccagcgcagcgcccaggcggctcgtgaaattaaaagcctgattgaagactcggtggggaaagtggatgttggctctacgctggtcgaaagcgccggggaaacaatggcggagattgtcagcgccgtgacccgcgtgacggacattatgggcgaaattgcttctgcttctgatgagcagagccgtggtatcgatcaggttggcttagcggttgctgagatggaccgggtaactcaacagaacgccgcgctggtggaagagtctgccgctgccgccgccgcgctggaagagcaggccagtcgcctgaccgaagcagtggcagtgttccggattcagcaacagcagcgtgaaacatcggctgtggtaaaaaccgtgacgccagctgcgccgcgtaaaatggccgtggcagatagcgaggagaactgggaaacattttaatcgccatgaaaatgcccgataagcaaaatgttatcgggcataaggagattaatctttacgtgggtcgttgatcggctgacgaaccaggaagatgtacgccagtgcccccgctgcggtgacgcaaccgcagatgattagtgccagacggaatgagtgggtggtatcaacaataaaaccagtaatgatcggcgcaaaagaggcgcagatgaagctggcaaagttctggatactgcccaccgacgcagtcatgcgagaagcaactgcgacgtggatcaagccccagcaggatgttccggcaaagtgaatacagaacagtgccatgccaatcagcagaaccgccgtcatggatgttgtcgcttgtggtactatcagcgtaaaggcggcagaacagaacatcccggcaataatgcagatcttacggcttttaatcggagccattccccctttgaccagccagtcggtaacgtaaccgttgaccagcatcccggcagccccaaacaggaaagggatagccgccatcaaccctgtgctttttaaatccaggttataggctgtttgcaggtaaccaggaagccaggccagatacagccacgcagtgtagttgatgccactgaatccgagcatcattccccacattgtacggttacggaacaggctgcgccattcggcaaaactgagcggatctcggcgggcattgacgctacctgcattgagataagcttgctcaacggcagtcagttctacgtgctcgcggttgcgatagagcatataccagccgatggcgagaaaaatccccagtacaccaatggtaataaacatcccgcgccagcccatcaccagcatcatcgccgccagaatcggtgggcttacggcaacgccaatggtagaagctgcgttgaagaagcccatcgggcgtccgcgctctttgatgttgaaccagtcgttaatgacttttacaccgcatgggttcatcggcgcttcaccaatccccataccgatacgcaccaacacgaactgcgtaaagttgtgcaccatgccagacattgcctggaacagtgaccagaagaacatccccagtcccagcatcaggcgtgggcctttacgatccaatagtgggccgcaaggaagttgcgcaatcccgtaagcgagtgaaaacacggagagcaaagcgccgatttcggtggcacttaatcccaattcttcacgaatcgttaaatttgctaccgacagcgaactgcggtcgagataattgattaccgccgcaaaaaataataacaacatggcggtggtttgaatgcgtttaattcgggtactgcgttgaactaatccatctggtggcacgggaatatctgccgacgaagatggagtaaatgaagaacgcggatcgatggtgatattttctttttccacgccggactcctgtatttataattttaattgtttacgtaattgtgcattacgcaaggttgacattaacggcaggttaaagttttaggactttactaccgctcacaaaaacatttttagtcgactgattgtgagcataggtaagcgggaatttcccggtatttatcttttgataaaaccgtgcacccgctaatagtttgctgtttttaatccgtacttaatgagcataacgcgtgttctcattaatggatcgaatcattgattgtttagctgaattcaaatggttacggagcgcaagggtggcatcaaggtcactgcggcaaatcagagcgctgagaatggtcatatgctcatcgacggcaatgatattgcgctgtttaagatcgctttcgtcccattgatagtgaaaatgaaagatgactgagatgatctcaagcgattgatcaaaaaagatattgtcggcagctgaaagcagtaaggagtgaaaatctctgtcaagttgcgagaacatgcgaaagctattgccgatgttgtcacgcagtagccgatgacgttcgagcatggttttcgcctgcagccagcggggatcatgatcaggcaggttgagaaagtgctgaagtgaatgtgtttcgagcatttcgcgtagctcaaacagctgctcggcgtaggattgatcgaattgcttcatgctccactggccgcgcttttcgctgtgaataagattataacggccgaattttaaaagatattctcttactacaaccgggctgacacccgcggcccgagccagttgcagttcagaaaacgtttcccctgggcgtaactggcgctggtttatcatcgtgaaaaaagcctgctcaaacactttgttttgttcactcattgaagcggtagtacaggcgaaaccgtcatcatggtcaggtttacgcgcaataacatagtcgtttccaacctgcgtcaagacgccgcattcgcgtaagtggctgagaatatgacgcactgtggtgcggctgatgttgtacatttccgccagcgcactttgcgatggaagtggggaagggatatgaccccgcgccatatcatcaatgacctggttaatcacattgtggcgtaaattttgtgaacgactcatattttcctccttgtgagtccattaaaacccgatttaaaacatttttatgcgtgtgttttcacaaaaaagattttccgttccgctgccatttttcattttcattgatatctaaggcaacaaaaagtggagagccgaatcatgtctacgatgaatgttttaatttgccagcagccgaaagaattagtctggaaacaacgcgagatacctattccgggtgacaatgaagcattaataaaaattaagtctgtcgggatttgcggtaccgatattcatgcctggggtggaaatcaaccattttttagttatccacgtgttttaggccatgaaatatgtggggagattgttgggctgggtaaaaatattgctgatcttaaaaatggtcagcaagttgctgtgatcccttatgttgcctgtcagcaatgcccggcgtgtaaaagcgggcgtaccaattgctgtgaaaaaatttcagtcattggcgtgcatcaggatggcggttttagtgagtatttgagcgtgccggtggcgaacattttgcccgcagacggtattgacccgcaggcggcagcattgattgaacctttcgctattagcgctcatgcggtgcgtcgcgcagccattgctcccggcgagcaggtgctggtggtcggggcggggccaatcggtctgggcgcggcggcaatcgctaaagccgatggcgcacaggtggtggtggcggataccagtccggcgcgccgtgaacatgtggcaacgcgtctggaattacctttactggacccgtcagccgaagattttgacgcgcagctacgggcgcagtttggtggttcgctggcgcagaaagtgatcgacgcgacaggtaatcaacatgcgatgaataacaccgtgaatttgattcgtcacggcggcacggtggtatttgtcggcctgtttaaaggtgagttgcagttctccgatccggaattccataaaaaagaaacgacgatgatgggcagccgcaacgccacgccggaagattttgctaaagtcggtcgactgatggcggaaggaaaaatcactgctgacatgatgttaacccatcgctatccgttcgccacgctggcagaaacctacgagcgcgatgtgattaacaatcgtgagttaattaaaggcgtaattactttctgataaggcgagattattaaagttgccatgcagcgtccggggaagtgttgggcgctgttttttttgtttcttaataatgtgttgtaagccgtagaaggcgtgtaggtcgcaccctatgcgacctacacatcagtcaggaattacccttcacgttctaccactttaatttccaccatgccgatcccgagcttacgcggcgagtgtccgaggatattcccttcgttggttgagacaggttccggcggcacaattaccagtgtgtcggcatcggttgggttatcgaaatgcagtgtggtggtggtcacttcattgcccagcacaagagtttgttcttcattgcctacgcgtaccggaataggacggctggcgttattgccgtatgctttggcggtaatcaccaggtcaaatttcttcggcagcggatgcttgtactcgatttttacttcatcgcccagctgcgcgttggaccagcggccccacgactccggacgggaaatcccgctaaactgtttcacctcttctggcgcaccggcgacgttaaagatgaaactgtcggctttgtagcgaatatcgttatcaacaatcttcagcgtatcgacattgcctttgtaacgcgccatgtcgatgaccgtatctttaaatgccgttttgccctgccatgttgttttgtcaacatgctgaacaatttgctgaccgccaagctgcccttgcgagacacaccagtcggtggaaagtgccagttccggagcccagagttgtgccatcttgtagcaacggtcaacccagacgaaattgtcgcgtggagcgaaatcggccagctggaaacgcagcggtgctgagtattcgctttccggcagcggttccacgcgtttgtctgaaacccgcaacagcagcggcaaacggaaatggctacccgagaaggcaatcatgtttttctgctggtcgatggtgaactctttcatctctttagggaatttccacaggcggatgatatctggcttccacgccaatgttttctctttgatattgaggaagatttccgacatcgactgcccggataaactgctacgaccaagtccgagatagttatcgccaccgagaatgtccagcaccgtcgcgccgttatccatcgtgttacgcttcactgccagcgtctcttgctgcggcttgtcgccacgaatgacaaaaaacaggttattgcgatcctgcttattgaggtatttccacgccgtgttgttcatcgctaaatggtcagaagagacgacgatgacggtatctttaaaccacggtgacgctttgattttgttgataaacgtcgcgatgttctcctggctgcaacttaccgcgctgaatgactgattcggtttaccgtcaaaatcatattttttgcggttacaggtacgagagataaaaccatccgggtgatgggtatcgactgtcagggtaaacagtgagaatcgctgacctgagcgggaaagctcttcaaactttttccacgcttcatcgagaacggtatcgtcgtagaatccccagtcgttgcgatagtgcgggtcggctaccacgcttttcagctcttctgagccgtataagtggtcgaagccatgcgacttcaggaacacatctttaccggcaaaacgcagattcgcgccctgcacgaaatagttctgataacccgagtttttcaggatatctcccagacagatgttctgcgggaagaagctggagacagaggcggaggcgttgccttcaaagggggcaaacagcggtatgccgcactgagaagccaccatgcccgcaatcgtgtaatctgttcccggcagctgctgcgtgtggctgaaatccaggccttcatttttcaacgcgcccagttcaggcgtgagatccgggaaagcctcgttatcaaaataggtccgctcgagactttcgccgtagatataaaccaggttgagtttcgggtcagggatagttttcgacggctctttataataagccgcaaagtccgggtcgccgtcgcgtgactgggatttcaccagttccgttatctgacgaaatgccgggctggcgtccaccgaacccagcgccagtaagagcgccagcaggctgtaaccaaaatggtgcggatgatggcgacgacggcgcaggatccagcccagcgcaccgaacaccgctgtcagccccagcacaatgccgatacccggcaaaatgtatttgctgacgccagcaccggtcaggctgttggttaaggtatagagaaccgcgtcgttaataccatcgccagtaaaatagtcgctggcaaacagggtgatatttaaaacgacaaatagccccagcaccgttaacgtggctgcaaaccaccaggtgttacgtcccgctttccatgcgtaaatcagcacagaggcgagaaaaagggcgaaagagagtagttctgacaacgggcgatcctcactaaaccgggccgtttagccaacgtttaagctttttgagaagcacaatgtaatggcgtcgccatattgctgcaattctagtgtcaaaaaaatgcgatgttgttaggaattagtttataaacagacttttttgattacggtcacttcccgtgtaacaggggtaaaaccgtccaggagcagggaaaagggcaggagagagccgcgtcagccgggtaacagctaaaacgcggcgtttcgcggttcaggaaatgaagttcagcccctgttttaacaccagatcgcaggctttggttttcaccttttctgccagcggagttgttccgatgttatccagattgagttgctgaccatctttggttttcagcaaaccctgaatgccgtccagatagttggtgtcttctttttgctcttcactgttcaggcccagcttttccagcacctggttcttgatgttttcggcatcggttaccgacgccagcttttgcttcgcgcagtattgcagaatgcctgcggcattgttcatgttatctgcgcttaaggcctggtttccgctgctaagcaagttagttaatgacgcgagcgaccaaccgccttcctgtgtcgtgctgttttggttgccaagttcgctggcggcgctggagagcgcatctttccaggacgcagcatgcaccccggtggaaattaatgcgctggcggcaatggcacagcacagaagatgtttaacagttttcatcatcattactcaaggtggaattgtgtcgcagtataccgccagaaacggggattaatactctttacctgttacccggctacggtagctatcccagttgaagatcacccacaaactgttacccaggcgcatacggtccatcacgcgttcgcccagcaacttggtcatctcttccatattactgttggtcagcatcccggttgggcgtttggaagaagagcggcgatcgacgatctggttgatgatcactttttcgtatttcgattcggtctgcacgccgatctcatcgatcaccagcagatcaacgttgctcagatcgttaagcagttgttcttcgctggtaccgctattcctgaaggtatctttcatcgccgacataatatcggccacggtgatgatcaatacggatttaccgcgtagcagcagctcgttgcagattgccgccgccagatggtttttgccggttcctggcttaccagaaaagatgaagctggcgatgttgccgtcaaactcttcgacatactggcgcgctttgcttaacgcattcatctgcccttcacactcaacgcgatagttctcaaaggaacagttctgatgcagtggacgaataccggagcggttaaaggtgcgctgcattttcatcgcccgattttcacgttcgagagcggcggagcggatcgctccttgttctttttgccaggccagtagttcttcacccgttttgaatgcgggtttgatatgggcaggcatcattttttgcaggcgttgcatcaggtcgccaacgtttttcatcgttaccctctgaatcctggtggaatttggctgtcaggttcgctgaccgtattcacatctcgtttcggcagtccgccgttgctggcacgaccgatttgcaggctgcgcgccagtttttgttgccactgcacatggtgaaagactttaccttccgcctgccagtaggcaatgaatgaggccagttcttcggtggtcaccggctctcttagcgccacgccccatagcgccgccaggcggataaaatcggcatcgggttgccagtccggatacatggcgaatttccccatgggtacagcaacgggagcggcttgcggttcctgatagagttgatcgtccagagcgacatcgcttcccggacgcgccagcttttcttccagcgccagcagttcagccaggcgtgcaggcgtgacggcataaaacgccggggcattgttagcaaatacggcaaccacaccgccttcagcttttgccagaacggtttggtgatcgtgtaccagggcgtcaataccaacgacgtccggggtcaaaactctggaagacatactgtttctcaaatatggaacgatgaacgagaagggagataacttttatagtaacacacggaggagaggaggctgtctctcatccgtgtgcttaagcgaggcaattttatacgcgagggcgcttgcggtacaaccataatccaggaatggaaagaccgatggataacgcaccaacaatcgatgaagctgtaagaaagttggttaacagggtaatcatcaacggttcgctgtaacctaactggctgatttttaccgccgaaatcattgcggtataagccgatatgcccgggaacatagggataacggccgccacggtaaacactttcggatgcgccagataccagcgcgaccattgaataccaatggtaccgaccagcatagaagccataaaggttgaccactcaatattcaacccgctggtcatcaagatcattcgggaaccatgacctatcgagccaagcagcgcacaccagcgtaacgcccgcacgggaacgttgaacaccatcgcaaagccgaccgcaggaatggcggcgaggatcatatcctgcgccaacgctaacagaaattcgatcacacccatccgcgtagcccccaaatcgtcagtgccatcactacgccgacgcaggtagccagtgtcagcagactggcgatcgcccagcgtgccagtccggtattgatgtggcctttaaacatatcggcgacggcattaatcaacggaaagcccggcactagcagcagaacgctggcggccatcgcaatggtgggggtattgctgaaagtggggagttgcaaaagcaatccggaaatggtggtggcggcgaaagcggtaaggcaaaagttgatctgtggatgaagatgacgttgtgccagcagctggcggatatacatcgcggtcgtactggcaaagaaggtgatgacggcaccatcccagccaccgttattgagtttacagaaacaggcgcaagaaaggccaaccattaaggctaccagccatcttgggtaacgtaatggctgaatttggctaaatcgtttctctacgcctttgtaatccagcagatgatgctccgcaagaatcacaatgtgctggacttcagtcaccacatgcatattaatgccgcgatcgtgatttttacgtgtcgatgtcaggcattgcccatctttaatagttgtcagcactatggcgttcgaagagatagaactttcgacgctgtccattcccagtgcccgacccagtcgtgaggaaagctcatcaaccaacgcgctttccgcaccatgttgcaaaagaaataatccacactggatacaaagccgtgttacggctcgctgttgctcagtttgcataactcgccctttgtcatagacgtgctgcgtattgttcagataatgagaatccatttgtatcatgaagcacggttgttttgcggtaggttaagatcaaaattgcgctgattaatcctggttatcgggagaagctcggtgataaaaagcgaattatctctcgccgcaaacaaactatcacatgaatattatcatcataatgaatttattgtttggcctttacgaatcaggataatagataaccgggcacgttttttaatgttaacaagctaaaaccatcagatttcattgaataaatattggttgtgtgattttgcattctgcgggaagggatatcatttaattataaattaaatgaatgtgatttctgtttttcattaagtattcctaacaacttaatgtagatattttaaatgtctccaggctatttcaccaggttatcatttgatgctaaccttctgacacatgcagtggagttgttgtgcagcaggagtatgctgatatgaaagtgaatgctaaggataatttattcgcttaatctattaatttgctggaaacatttaaggaatgaatatcctgaataaaccatcataatttttagacagtggatgtggaggaaatatgttgccaggatgctgcaaaaatggaattgttatcagtaaaatacctgttatgcaagcagggttaaaagaggtcatgaggactcacttccctgaatatgaaataatatccagcgcctctgcggaggaccttaccttattacaattacgtcgttccggattagtcattgctgatttagccggtgaaagtgaagatccacgttctgtttgtgaacattattattctttaatctcacaatatcgggaaattcactgggttttcatggtgtcacgctcctggtattcccaggcagtagaactgctcatgtgccctacggcgacgttattgtctgatgttgaacccattgagaatctggtcaagaccgtacgttccggcaatacgcacgcagagcgtatcagcgccatgctgacctccccggcaatgactgaaactcatgattttagctatcgctccgtcattctcactctttcagagcgcaaggtactgcggctattaggtaaaggatggggcatcaaccagatagcttcattgcttaagaaaagtaataaaactatcagcgcccaaaaaaacagtgcgatgcgtcgactggcaattcacagcaacgctgaaatgtatgcatggataaatagcgcgcagggtgcaagagaacttaacttgccttctgtttatggagatgccgcagaatggaacacagccgaattaagaagagaaatgtcgcactcatagaaaaatgcgtcatgagtagtatcggtattgagagtttattcagaaagtttgcgggtaacccttataagctccatacctataccagtcaggagtcatttcaggatgccatgtcgcggatctcgtttgcggcggtcattttttctttttctgccatgagaagtgagcgcagagagggattatcttgcctgactgaactggcgattaagtttccgcgtacccggcgtttagttattgcggatgatgatattgaagctcggctgattggttcattgtcgccatcaccgctggacggtgtattaagtaaagcgtcaacgctggagatttttcatcaggaactctttttgtcattaaatggtgtacgtcaggcgaccgaccgactgaacaatcagtggtacattaaccaaagccggacgttaagcccgacggagagagaaatattgcgctttatgtcgcgtggctactcaatgacacaaattgccgagcagcttaaacgcaatatcaaaacgatccgtgcacataaatttaatgtgatgtcgaaactgggcgtcagttctgacgcagggttgttggaggccgcagatattctgttatgtatgcggcattgcgaaacaagtaatgtgttgcatccctattaatccgcatgatgccgggtttacttccccggcagtgctttcatttcagcgtacaatcgccacattgctgcacatccggtaagcgataacgctggcagcaagtgcggcgcaccagcaggccgtcgcgcagtaccacggtacgccagagtggattatcttcaccgttcgtgagcgttttctcaaaaaagagggcatggcgcagcgattcaacagtagcctcgccgagcagttgcttcatctcagtgagataccagttgatcaaataaccggtattactccagataagtttgccgttgatctctccggtcgcttctagtgcttgcacaaccggaaccagcgcctggctgattaacgtttccattcgatgctgcggcgaatgtggtgttgcgtttttatcttcacacacatcgacccagaaacaggcgacgcgtccggtttcgtgaaactcagcatggaaatgttccggcgacacatctaatgccttttcctgcgtcagtagcgccagcattaatggtggcaccatcaggccgatataccattgtgcccatagtgagatcagcggtttgttctcgcggatcatcatcggttggttgcgatagatatgatcggaatagaccgccagcagagaacttagcacattcggtgatgaccattgcgccagcgtcatggcgttaagtggggcaggttcatccaggcggataaactccagcaaatgttcacgatgttttgcgatcgtcgcccgcacggcttgcgcaagcgtgggatcctgcggctggagatgcgttcgccagatgacatcttcatagagcggtgcggaacgataggccataatcgggatagtaatctaaatgataatgattgctaatcatagcgataggtttacccgatagcaagggatttatctggcttgcaaatgataaaaattatcatatgatattggttatcattatcaatgaaagagatgaaatcatgttgcaacgtacgctgggcagtggctggggagtgttgctgccgggattgctgattgcagggctgatgtatgcggatttatcgtcagatcagtggcggattgtcattctgatgggattagtattgacgccgatgatgctgtatcacaaacagttgcggcattacattttgctaccatcgtgcctggcacttattgctggcatcatgctgatgataatgaatttgaatcagggatgaaaaatcaaggaagaaacaagaaaggaagtaaagataattggtgcgaggggggggacttgaacccccacgtccgtaaggacactaacacctgaagctagcgcgtctaccaattccgccaccttcgcacagtcatcttactttttttgatatcgcctcgtttggtgcgaggggggggacttgaacccccacgtccgtaagaacactaacacctgaagctagcgcgtctaccaattccgccaccttcgcccagtgcgagcaatatcaacgtggtttttggtgcgaggggggggacttgaacccccacgtccgtaaggacactaacacctgaagctagcgcgtctaccaattccgccaccttcgcataccatcaattcttaaaaagaattgctaccacggaggcgcattctagtggttttcagcttttcgtcaatagttaattatcgacagaggtgtaattgctggaaaaatgtccatcaggaaactagcgtgcaggtttggtatgcatgcgggggcagatgccagatgcgacgctggcgcgtcttatctggcctacgaagggctaacgtgcaggttttgtaggtcggataaggcgttcacgccgcatccgacacggtattcggcgagataattaacctttcttcgcctggcgggtcataatggcgcgatacaccttgaagcgccctgtttgcgcgatcacttcgtggaagccaaatgtctcatccagcacgtccggataaggcaggaaggcgttcgctacaattcgcagctcgccgccgctattaagatgacgcaccgcaccgcgaatcagcgtttgcgccgcatccaggctggtttgcatcccatcgtggaacggcgggttggagatgatcatatcaaaacgacctttcacctcggaaaagacgttgctggcaaagacttcaccttcaacaccgttggccgcaagtgttgcgcggctggcttctaccgccggggcagagacatcgcacaaggtgagacgaattttcggcgaatggcgcgcaaaggcaactgaaagcacgcccgcgccacagccgacatccagcactttacctttcgtgtgcggagttaacgtcgagagcagcaactggctaccgacatccagaccgtcgcggctaaacacgccaggcagcgttttgaccgtcaggccatcgacgctgtattcgccccagaatttctccgcatcaaataccggctgtttttccagacgaccaaaatagaggccacagcgacgagcgctgtcgactttattcaacggcgcataatctgccagcatctgctcggcgctgcgcacgccgctgcggttctcgccaacgacaaaaatatctgtccccactggcagcagagaaagtaaattcatcaactggaactgggcttccggtttgttcttcggccagtagtaaatcagcgtatcgcaatctgcgacgtcatccgccgtggcgaccagactgaaacgggcgttatcccccatctggcggcttaatacctgccagtggtggaattgctgggtatgagcacggctggccgcggtatctaaacgcgcgggcaggtcatcctgtaagtctccggcaaacagaatacggctttgttcgaaatcatcactgtgacgcagcaagacttcacttgccggggtaaatgcagacatggaatgctcctcaattgatactggcggcgattatagccatatgttggcgcggtatcgacgaatttgctatatttgcgcccctgacaacaggagcgattcgctatgacatcccgacgagactggcagttacagcaactgggcattacccagtggtcgctgcgtcgccctggcgcgttgcagggggagattgccattgcgatcccggcacacgtccgtctggtgatggtggcaaacgatcttcccgccctgactgatcctttagtgagcgatgttctgcgcgcattaaccgtcagccccgaccaggtgctgcaactgacgccagaaaaaatcgcgatgctgccgcaaggcagtcactgcaacagttggcggttgggtactgacgaaccgctatcactggaaggcgctcaggtggcatcaccggcgctcaccgatttacgggcaaacccaacggcacgcgccgcgttatggcaacaaatttgcacatatgaacacgatttcttccctcgaaacgactgatttaccggcggcttaccacattgaacaacgcgcccacgcctttccgtggagtgaaaaaacgtttgccagcaaccagggcgagcgttatctcaactttcagttaacgcaaaacggcaaaatggcggcgtttgcgattacgcaagtggtgctggatgaagctacattgttcaatattgcggtcgatcctgactatcagcgtcagggattgggaagggcgctgctggaacatctgatcgacgaactggaaaaacgcggcgtggcgacactatggctggaagtccgtgcttcaaacgctgccgccattgccctgtacgaaagtttaggctttaacgaggcgacgattcgccgcaattactaccccaccacggacggtcgcgaagacgccatcatcatggcgttgccaatcagtatgtaatacaaggtggaataatgaagtgggactggattttctttgatgccgatgaaacgctgtttacctttgactcattcaccggcctgcagcggatgtttcttgattacagcgtcacctttaccgctgaagattttcaggactatcaggccgttaacaagccactgtgggtggattatcaaaacggcgcgatcacttcattacagcttcagcacgggcggtttgagagctgggccgaacggctgaacgtcgagccaggtaaactcaacgaagcctttattaatgcgatggcggaaatctgcacgccgctgccgggcgcggtttctctgcttaacgccattcgtggcaacgccaaaatcggcatcatcaccaacggctttagtgccttgcaacaggtgcgtctggaacgcacgggcctgcgtgattacttcgatttgctggtgatttccgaagaagttggcgttgccaaaccgaataagaaaattttcgattatgcgctggaacaggcgggcaatcctgaccgttcacgcgtgctgatggttggcgacactgccgagtccgatattctcggtggcatcaacgccgggcttgcgacctgctggctgaatgcacaccatcgcgagcaaccagaaggcatcgcgcccacctggaccgtttcttcgttgcacgaactggagcagctcctgtgtaaacactgattgcctcccccccgttgatgggtaaaatagccgcaatttttcgttttcaacaagcgcggcgcgatgccgcttactcaagaagaaagaattatgacgttgtctccttatttgcaagaggtggcgaagcgccgcacttttgccattatttctcacccggacgccggtaagactaccatcaccgagaaggtgctgctgttcggacaggccattcagaccgccggtacagtaaaaggccgtggttccaaccagcacgctaagtcggactggatggagatggaaaagcagcgtgggatctccattactacgtctgtgatgcagtttccgtatcacgattgcctggttaacctgctcgacaccccggggcacgaagacttctcggaagatacctatcgtaccctgacggcggtggactgctgcctgatggttatcgacgccgcaaaaggtgttgaagatcgtacccgtaagctgatggaagttacccgtctgcgcgacacgccgatcctcacctttatgaacaaacttgaccgtgatatccgcgacccgatggagctgctcgatgaagttgagaacgagctgaaaatcggctgtgcgccgatcacctggccgattggctgcggcaagctgtttaaaggcgtttaccacctttataaagacgaaacctatctctatcagagcggtaaaggccacaccattcaggaagtccgcattgttaaagggctgaataacccggatctcgatgctgcggttggtgaagatctggcacagcagctgcgtgacgaactggaactggtgaaaggcgcgtctaacgagttcgacaaagagctgttccttgcgggcgaaatcactccggtattcttcggtactgcgctgggtaacttcggcgtcgatcatatgttggatggcctggtggagtgggcacctgcgccgatgccgcgtcagactgatacccgtaccgtagaagcgagcgaagataaatttaccggcttcgtatttaaaattcaggccaacatggacccgaaacaccgcgaccgcgtggcgtttatgcgtgtggtgtccggtaaatatgaaaaaggcatgaaactgcgccaggtgcgcactgcgaaagatgtggtgatctccgacgcgctgacctttatggcgggtgaccgttcgcacgttgaagaagcgtatccgggcgatatcctcggcctgcacaaccacggcaccattcagatcggcgacacctttacccagggtgagatgatgaagttcaccggtattccgaacttcgcaccagaactgttccgtcgtatccgcctgaaagatccgctgaagcaaaaacagctgctcaaagggctggtacagctttccgaagagggcgcggtgcaggtgttccgtccaatctccaacaacgatctgatcgttggtgcagttggtgtgctgcagtttgatgtggtggtagcgcgcctgaagagcgaatacaacgttgaagcagtgtatgagtcagtcaacgttgccactgcccgctgggtagaatgtgcagacgcgaagaaattcgaagagttcaagcgtaagaacgaaagccaactggcgcttgatggcggcgataacctcgcttacatcgctaccagcatggtcaacctgcgcctggcacaggaacgttatccggacgttcagttccaccagacccgcgagcattaattcttgcctccagggcgcggtagccgctgcgccctgtcaatttcccttccttattagccgcttacggaatgttcttaaaacattcacttttgcttatgttttcgctgatatcccgagcggtttcaaaattgtgatctatatttaacaaagtgatgacatttctgacggcgttaaataccgttcaatgcgtagatatcagtatctaaagccgtcgattgtcattctaccgatattaataactgattcagaggctgtaatggtcgttattcatcactcatcgcttttgtgatggcgaccattgacttctgtagagggtgaagtctctccctattcagcaatgcaacctcgtgttgccaggctcaaattacgagcaaacatacaggaataaatcgatgactatgacaagactgaagatttcgaaaactctgctggctgtaatgttgacctctgccgtcgcgaccggctctgcctacgcggaaaacaacgcgcagactaccaatgaaagcgcagggcaaaaagtcgatagctctatgaataaagtcggtaatttcatggatgacagcgccatcaccgcgaaagtgaaggcggccctggtggatcatgacaacatcaagagcaccgatatctctgtaaaaaccgatcaaaaagtcgtgaccctgagcggtttcgttgaaagccaggcccaggccgaagaggcagtgaaagtggcgaaaggcgttgaaggggtgacctctgtcagcgacaaactgcacgttcgcgacgctaaagaaggctcggtgaagggctacgcgggtgacaccgccaccaccagtgaaatcaaagccaaactgctggcggacgatatcgtcccttcccgtcatgtgaaagttgaaaccaccgacggcgtggttcagctctccggtaccgtcgattctcaggcacaaagtgaccgtgctgaaagtatcgccaaagcggtagatggtgtgaaaagcgttaaaaatgatctgaaaactaagtaattcgtcgtaattcgtcctcccgaactttgtcgggaggcgcgatgtgcaccacactaaaaatatcgcattgagtgattttcacgctcatatcaagcggtgacattaactatggtaaaggagacgcttatgtttcgttggggcatcatatttctggttatcgcgttaatcgccgccgcacttgggtttggtggtctggccggtaccgctgcaggcgcagctaaaattgtctttgtcgtcgggattattctgttcctggtgagtttgttcatgggccgaaaacgaccctagatttcagaccattaagaaaattttatccaaagccagtccagcggactggcttttgcggttttagcgaataataaattgcgttactttgtcattctttcacaacaaaaacaggaaggcagaggtggggcagcgaatacctgtaacgcttggtaatattgcgccgttgtcgctaaggccgttccagcctggacgaatagctctggtgtgcgaaggcggcggacagcgtggaattttcacggctggcgtgctggatgagtttatgcgcgcgcagtttaatcctttcgatctttatctcggcacatctgccggggcgcagaacctctcggcgtttatctgcaatcagcccggttacgcgcgcaaagtcatcatgcgctataccacaaaacgcgaatttttcgatccattgcgctttgtccgtggaggaaatcttatcgatctcgactggctggtggaggccactgcaagccagatgccgttgcaaatggataccgccgcgcggttgtttgacagcggcaaatcgttttatatgtgcgcctgtcgtcaggatgactacgcgccgaattactttttaccaaccaaacaaaactggctggatgtgattcgcgcctccagtgcgatacctggcttttatcgtagcggagtgtcgctggaaggcattaactacctggatggcgggatcagtgatgcgattccggttaaagaggcggcaaggcagggcgctaaaacgttggtcgtcattcgcactgtgccgtcacaaatgtactacacgccgcagtggttcaaacgcatggaacgctggctgggtgacagtagcctgcagccgctggtcaatctggtgcagcatcatgaaaccagctatcgtgacattcagcaatttattgagaaaccaccgggcaagctgcggatattcgaaatttatccgccgaagccattacatagtatcgcgcttggcagtcggattccggcgctgcgtgaagactataaacttgggcgtttatgcggtcgttatttcctcgccacggttggcaagctattaactgaaaaagcgccgcttacccgccatctggtgccagtggtgacgccggaatcgattgtcattccgcctgcgccagtcgccaacgatacgctggttgccgaagtgagcgacgctccgcaggcgaacgacccgacatttaacaatgaggatctggcttgatttgccgttttatcgacacccactgccattttgatttcccgccgtttagtggcgatgaagaggccagcctgcaacgcgcggcacaagcgggcgtaggcaagatcattgttccggcaacagaggcggaaaattttgcccgtgtgttggcattagcggaaaattatcaaccgctgtatgccgcattgggcttgcatcctggtatgttggaaaaacatagcgatgtgtctcttgagcagctacagcaggcgctggaaaggcgtccggcgaaggtggtggcggtgggggagatcggtctggatctctttggcgacgatccgcaatttgagaggcagcagtggttactcgacgaacaactgaaactggcgaaacgctacgatctgccggtgatcctgcattcacggcgcacgcacgacaaactggcgatgcatcttaaacgccacgatttaccgcgcactggcgtggttcacggtttttccggcagcctgcaacaggccgaacggtttgtacagctgggctacaaaattggcgtaggcggtactatcacctatccacgcgccagtaaaacccgcgatgtcatcgcaaaattaccgctggcatcgttattgctggaaaccgacgcgccggatatgccgctcaacggttttcaggggcagcctaaccgcccggagcaggctgcccgtgtgttcgccgtgctttgcgagttgcgccgggaaccggcggatgagattgcgcaagcgttgcttaataacacgtatacgttgtttaacgtgccgtaggccggataaggcgttcacgccgcatccggcagttggcgcacaatgcctgatgcgacgcttaacgcgtcttatcatgcctacaggtttgtgccgaaccgtaggccggataaggcgttcacgccgcatccggcagttggcgcacaatgcctgatgcgacgcttgtcgcgtcttatcatgcctacaagtctgtgccgaaccgtaggccggataaggcgttcacgccgcatccggcagtcggcgcataatgcctgatgcgacgcttgtcgcgtcttatcatgcctacaggtttgtgccgaaccgtaggccggataaggcgttcgcgccgcatccggcagttggcgcacaatgcctgatgcgacgcttgacgcgtcttatcaggcctacaagtctgtgccgaaccgtaggccgtatccggcatgtcacaaatagagcgccggaaatatcaaccggctcaccccgcgcacctttaacgcatcagccaacggctcaacgtcttccggcgtggcgctcgcccagctttgcgcctcgccatacacgccgtgggcatgaaacgcgttcaggcgtaccggaacatcgccgagtcccttgataaacgccgccagttcttcgatgtgttgcaaataatccacctggccagggatcaccagcaaacgcagttccgccagcttgccgcgctctgccagcaaatagatgctgcgcttaatctgctgattatcgcgtccggtgagttgttgatgacattcgctcccccacgctttgagatcgagcattgcgccgtcgcacaccgggagcaatttttcccagccggtttcgctcaacatgccgttactgtccaccagacaggtgagatggcgcagttgcggatcgtttttgatagcagtaaacagcgccaccacaaacggcagctgggtcgtggcttcaccgccactcaccgttatcccttcgataaacagcactgctttgcggacatggctaagcacttcgtccacgctcatggattgcgccatgggcgtggcatgttgcggacacctcttcaggcaggtatcacactgctcgcaaaccacagcgttccacaccactttgccgtcaacaatctgcaacgcctgatgcggacactgtggcacgcactccccacagtcattgcaacgtcccatcgtccacggattgtgacagtttttgcagcgcagattgcagccctgcaaaaacagagccagacgactgcctggcccgtcaacgcaggagaaggggataatcttactgactaaagcgcatctgctgttcatggcttatcacgcgcggctggcgttccagaatacgagtgttgcgtgcggcttcttcgcccagccaggtggtgttggtgcgtgaaccttcggcgcgatatttttctaaatccgacaaacgcaccatataaccggtaacgcgaaccagatcgttaccgctgacattggcggtaaattcacgcattccggctttaaaggcaccgaggcaaagctgtaccagtgcctgcgggttacgtttgatggtttcgtcgagcgtcagaatgtcgctgatgccggaataataataagcatgatgcggggcgacagtttgcagatgggtgatcggatctggctcatcgccatacggcaaacgcgcgcccggcgtggtgccgatatcggaactgatccccgactgtgcgtgtaacatggcgcgtttttgccagccatatttcacgggggtattggcgacaaactccgccagttgcgcgctgatgcgataacctacttcatttgcggcggcttctttaccgtagcgcgcggcaatcccttctttttcacacagcaagttaaccgcttccgccagcccatacatgccaaacattggcacaaaacgttcagggttaatcagcccttctttcaccaggaagctattctcaaagaagtgtgattgttgatagaggaattcacaccgcgcatcgatgatggcgatctgctgctggcagtagtgcggtagagtgcgcgtaaagaagtcatccagcgattcgctgcgctcggcaatggctttcaggttaaggcgtaccagcgtgctgccaccacccgccagcggcagtgagttgtaacagctcacaatcccgtagcccccttttgtgaaaattttatcatgcaccggaccgttggcgatgtgcggtttgctacattcacagatgttcttcgccacttccagcagcaggtcatcaggggtgatttcaggatcgtagataaaggtcaggttcggtgaaacctgcttcaactctgcatctgcacgtaagatcgcgcgggtaatgggcgaatcagacgggccgatattggcgtgcataaaggcgtctggcagggttctgtcgaggtaacgccagaaacgttttattcgaacatcgatctcgtcttgtgttagaattctaacatacggttgcaacaacgcatccagttgccccaggtagaccggcatcgatgtgaccgacggtacgtggtggtaaagaatggtcagcagagagagtgcgtcatcaagatctttcgcgccttccagctccagccattcggaaccgttcgccagaaaacgggcgtaatcgggtaagacatagcgcggtttgtacggcgcatgaccttcaaacatatcgcagattacaccttcatccagcgcgcggcgggcttcggcaggaagctgtgggtaaggcagattgttttctgcttccagtgccagaaaatggcgcttctgctccgggctaagcactgggctggtgacaatttgctggcaacgttgttgcagtgcattttcatgagaagtgggcatcttcttttccttttatgccgaaggtgatgcgccattgtaagaagtttcgtgatgttcactttgatcctgatgcgtttgccaccactgacgcattcatttgaaagtgaattatttgaaccagatcgcattacagtgatgcaaacttgtaagtagatttccttaattgtgatgtgtatcgaagtgtgttgcggagtagatgttagaatactaacaaactcgcaaggtgaattttattggcgacaagccaggagaatgaaatgactgatctgaaagcaagcagcctgcgtgcactgaaattgatggacctgaccaccctgaatgacgacgacaccgacgagaaagtgatcgccctgtgtcatcaggccaaaactccggtcggcaataccgccgctatctgtatctatcctcgctttatcccgattgctcgcaaaactctgaaagagcagggcaccccggaaatccgtatcgctacggtaaccaacttcccacacggtaacgacgacatcgacatcgcgctggcagaaacccgtgcggcaatcgcctacggtgctgatgaagttgacgttgtgttcccgtaccgcgcgctgatggcgggtaacgagcaggttggttttgacctggtgaaagcctgtaaagaggcttgcgcggcagcgaatgtactgctgaaagtgatcatcgaaaccggcgaactgaaagacgaagcgctgatccgtaaagcgtctgaaatctccatcaaagcgggtgcggacttcatcaaaacctctaccggtaaagtggctgtgaacgcgacgccggaaagcgcgcgcatcatgatggaagtgatccgtgatatgggcgtagaaaaaaccgttggtttcaaaccggcgggcggcgtgcgtactgcggaagatgcgcagaaatatctcgccattgcagatgaactgttcggtgctgactgggcagatgcgcgtcactaccgctttggcgcttccagcctgctggcaagcctgctgaaagcgctgggtcacggcgacggtaagagcgccagcagctactaagtaagatgctttacgcctgatgcgctgcgcttatcaggcctacgagacgtatctacccgtaggccggataaggcgtagacgcatccggcaaaagccgcctcatactcttttcctcgggaggttaccttgtttctcgcacaagaaattattcgtaaaaaacgtgatggtcatgcgctgagcgatgaagaaattcgtttctttatcaacggtattcgcgacaacactatctccgaagggcagattgccgccctcgcgatgaccattttcttccacgatatgacaatgcctgagcgtgtctcgctgaccatggcgatgcgagattcaggaaccgttctcgactggaaaagcctgcatctgaatggcccgattgttgataaacactccaccggtggcgtcggcgatgtgacttcgctgatgttggggccgatggtcgcagcctgcggcggctatattccgatgatctctggtcgcggcctcggtcatactggcggtacgctcgacaaactggaatccatccctggcttcgacattttcccggatgacaaccgtttccgcgaaattattaaagacgtcggcgtggcgattatcggtcagaccagttcactggctccggctgataaacgtttctacgcgacccgtgatattaccgcaaccgtggactccatcccgctgatcaccgcctctattctggcgaagaaacttgcggaaggtctggacgcgctggtgatggacgtgaaagtgggtagcggcgcgtttatgccgacctacgaactctctgaagcccttgccgaagcgattgttggcgtggctaacggcgctggcgtgcgcaccaccgcgctgctcaccgacatgaatcaggtactggcctccagtgcaggtaacgcggttgaagttcgtgaagcggtgcagttcctgacgggtgaatatcgtaacccgcgtctgtttgatgtcacgatggcgctgtgcgtggagatgctgatctccggcaaactggcgaaagatgacgccgaagcgcgcgcgaaattgcaggcggtgctggacaacggtaaagcggcagaagtctttggtcgtatggtagcggcacaaaaaggcccgaccgacttcgttgagaactacgcgaagtatctgccgacagcgatgctgacgaaagcagtctatgctgataccgaaggttttgtcagtgaaatggatacccgcgcgctggggatggcagtggttgcaatgggcggcggacgccgtcaggcatctgacaccatcgattacagcgtcggctttactgatatggcgcgtctgggcgaccaggtagacggtcagcgtccgctggcggttatccacgcgaaagacgaaaacaactggcaggaagcggcgaaagcggtgaaagcggcaattaaacttgccgataaagcaccggaaagcacaccaactgtctatcgccgtatcagcgaataacggtatactgatctgatcatttaaatttgaagcactgagtacggagaacatatgaaacgtgcatttattatggtgctggactcattcggcatcggcgctacagaagatgcagaacgctttggtgacgtcggggctgacaccctgggtcatatcgcagaagcttgtgccaaaggcgaagctgataacggtcgtaaaggcccgctcaatctgccaaatctgacccgtctggggctggcgaaagcacacgaaggttctaccggtttcattccggcgggaatggacggcaacgctgaagttatcggcgcgtacgcatgggcgcacgaaatgtcatccggtaaagataccccgtctggtcactgggaaattgccggtgtcccggttctgtttgagtggggatatttctccgatcacgaaaacagcttcccgcaagagctgctggataaactggtcgaacgcgctaatctgccgggttacctcggtaactgccactcttccggtacggtcattctggatcaactgggcgaagagcacatgaaaaccggcaagccgattttctatacctccgctgactccgtgttccagattgcctgccatgaagaaactttcggtctggataaactctacgaactgtgcgaaatcgcccgtgaagagctgaccaacggcggctacaatatcggtcgtgttatcgctcgtccgtttatcggcgacaaagccggtaacttccagcgtaccggtaaccgtcacgacctggctgttgagccgccagcaccgaccgtgctgcagaaactggttgatgaaaaacacggccaggtggtttctgtcggtaaaattgcggacatctacgccaactgcggtatcaccaaaaaagtgaaagcgactggcctggacgcgctgtttgacgccaccatcaaagagatgaaagaagcgggtgataacaccatcgtcttcaccaacttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaccggtactgaccacacgcgtgaacacattccggtactggtatatggcccgaaagtaaaaccgggctcactgggtcatcgtgaaaccttcgcggatatcggccagactctggcaaaatattttggtacttctgatatggaatatggcaaagccatgttctgatggatttgggcggagcgttgactccgcctttgttatgtcacaaaaaggataaaacaatggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactgcgcgacgtcgttatcggtatgggtgcctgcaccgattccaaagttaaccgcatccgttttaaagaccatgactttgccgctatcgctgacttcgacatggtgcgtaacgcagtagatgcagctaaagcactgggtattgatgctcgcgtgggtaacctgttctccgctgacctgttctactctccggacggcgaaatgttcgacgtgatggaaaaatacggcattctcggcgtggaaatggaagcggctggtatctacggcgtcgctgcagaatttggcgcgaaagccctgaccatctgcaccgtatctgaccacatccgcactcacgagcagaccactgccgctgagcgtcagactaccttcaacgacatgatcaaaatcgcactggaatccgttctgctgggcgataaagagtaattgtgtttcgctgcaaggcgattgccttgtgaagccggagcgggagactgctccggctttttagtatctattcatttttctctccagcttgaatattttcgctatacttttcagtgaaatgtgttaataaatctattcaagtatctattcacgaatctattcattaatgagcgagctgactgatcttttactgcaagggccgcgttctgccccggaattgcgccagcgtctggcaatcagtcaggcgacgttctcacgccttgttgccagagaagatcgggtgattcgctttggtaaagcacgggcaacgcgatatgcactgctgcgtccttatcgcggaattgagcgtattcccgtctggcgggtggacgataccggaaaggcgcataaattcgccgacatccggttgtgctggccgcagggaagttgtctggtaacaggcgcagatggcgacgaacagtggtttgatggtttgccctggtatttgaccgatctccgaccgcagggctttttagggcgcgcgtggggcaggaagttagccgcgcaactgaatctgactgatgatatacgtctctggcaggaagaagatgtgctctacgccctgaccgtatttaacggtgaatatactggcggttggttggtcggggaggggaattatcagcgatggattactgcacaacaccctgcggaaattcctctggatcaaaaactcacccattacgaacagctggcaagtgatgcactggcaggagaaattgtgggttcttctgcgggcggcgagcagccaaaatttacctactatgcacaaacgccgtcaggcaataaacatgtgttggtgaaattcaccgtaccacagcaaaccgcggtcagccaacgttggggtgacctgctaattgctgaatctattgccgcgcaaatcctgcgtgacggtgggatccacgccatcgagtcaacggtgcttgtaacaagtaacaggcaggtattcctcgaagcggaacgctttgactgcaaaggtaacgatggtcgcttgcctattgtgtcgctggaggcggtgcagagtgagtttatctcttctccgggatcgtggccgcaggcaatgcgccgtttgtgtgagcaacaacttgtcactcaccagagcgtggcgcaaacagaagtgatctgggcatttgggcgacttatcgccaacagcgatatgcacgcaggtaatttatcgttttatttatctgaaccgccatttgcgctgacgcccgtctacgacatgctgccgatggtctatgcaccaaacagcgctggaatgctgcgtgatgctgccattgaggtgaagtttgatcttaacgtcagtaaaagcgcttggttaacggcgatcccgctggcgcagcagttctggcaaacggtcgccagagatccgcgtatcagcgaggcgtttcgccacattgcgcaagaaatgccggaaaaaatccggcaaatcgaagagaaagttgcccgcatgggcgggtaactaccttacagcccccgccatccatgccgataactcccgtagctctttttcctgttccgggaagtcaaccaacagcgcttcgcactcctgttgcagcatatctgcgcggtacaggcagccttgcagtcgtccggcgagggcttccagcggcgcggggttgaggctgtcggtaaacacctgggcgcgggtgatatggcctttttcaacgtcgaaatgcagttccacgccgccccaggtaaagcgttcatccagcagatgcgagaatgccggagcctgaccgaagttccattcccagctactctggcgggcaaaggtttcggcgaagtttggcaagtctggcgttttgttcggggagatgatttccgcttccacgcgctcgccataatgggcgaaaaaggcctcggttatggcctcgcaaacctgctcatgggtgatccccggcaacagctcggtgaggttggtcacgcgggaacgtaccgacgtaatgcctttcgccgccagtttctttttatccggattgagatagtttgccaggcggctgaggtcggcattgagtagcaaggtgccgtggtggaagccgcgatctttggtttcgcgataggccgagcctgagactttgcggtcgccttcgacggttttcaccaccagatcgttacgtccggacgcttcggcgctgacgccgagcgcgttcagcgcattgagcacaatcgacgtggagatagttttatcgtactccggcttgccagccataaaggtaaagcaggtattgccgagatcgtggaacaccgcgccgccaccgctactgcgccgcgccaggcggacgttatcttcttccatccgccgggtattacactctttccacgggttctgcgcgcgaccaattactaccgtgtcggcattgcgccagagaaacagaacgcgctgcgtggcgggcatttggcgaaaaatacactcttccaccgccaggttaaaccacgggtcgtaagagtcagagatgagcaggcgtaatgtggacataacgatttcctttcttgtagtaatgggtcactcttttttctcgctttcttcctcttccggcaccggtttgctggcggttaacaggaagggcgattgctgccagcgggtgcgtttaccctgtagcagcgtgcgggtcagcactacaccgattgccagtgagagcagcaacatcaggcgtaaaatgttagtggtgttatccacctgttgggcttcggtggcgagcgtatgggtgtcgagtgtcaggcgcagatagccgagcggtccgtttttacccgcaattggctcgacaatctgctggttaaaatagccgcctgcttttttaccgtcgagcgccagccggtcgcgcacttcgacgctttcgccagaacgtgcgataagatcgccttgttcgtcatacacacccgcgtcgaggatacggctttcatccgttaactgatcgaggatcgcctgaatgcgtttttcatccggtgagtcggtacgcatcagcggtgcaacgttcagcgtcacctgacgcgccagggtgcgggccagttcttccagctgtggattacgctgtcgctggtggttttgactaaaccatgacgctccctgcatcagcgccactaacaaggcaagacagaacaggacaatcactgcccgatgcagccggaatttcagttttgtgcgagccatcttccaccctttgaaaatttgagacttaatgttgccagaagcaatggatacaaggtagcctcatgcgttattttccctgcttcgaacgattttacaggagccttaatgcctaacattacctggtgcgacctgcctgaagatgtctctttatggccgggtctgcctctttcattaagtggtgatgaagtgatgccactggattaccacgcaggtcgtagcggctggctgctgtatggtcgtgggctggataaacaacgtctgacccaataccagagcaaactgggtgcggcgatggtgattgttgccgcctggtgcgtggaagattatcaggtgattcgtctggcaggttcactcaccgcacgggctacacgcctggcccacgaagcgcagctggatgtcgccccgctggggaaaatcccgcacctgcgcacgccgggtttgctggtgatggatatggactccaccgccatccagattgaatgtattgatgaaattgccaaactggccggaacgggcgagatggtggcggaagtaaccgaacgggcgatgcgcggcgaactcgattttaccgccagcctgcgcagccgtgtggcgacgctgaaaggcgctgacgccaatattctgcaacaggtgcgtgaaaatctgccgctgatgccaggcttaacgcaactggtgctcaagctggaaacgctgggctggaaagtggcgattgcctccggcggctttactttctttgctgaatacctgcgcgacaagctgcgcctgaccgccgtggtagccaatgaactggagatcatggacggtaaatttaccggcaatgtgatcggcgacatcgtagacgcgcagtacaaagcgaaaactctgactcgcctcgcgcaggagtatgaaatcccgctggcgcagaccgtggcgattggcgatggagccaatgacctgccgatgatcaaagcggcagggctggggattgcctaccatgccaagccaaaagtgaatgaaaaggcggaagtcaccatccgtcacgctgacctgatgggggtattctgcatcctctcaggcagcctgaatcagaagtaattgctcgcccgccatcctgcgggcggcacagcattaacgaggtacaccgtggcaaaagctccaaaacgcgcctttgtttgtaatgaatgcggggccgattatccgcgctggcaggggcagtgcagtgcctgtcatgcctggaacaccatcaccgaggtgcgtcttgctgcgtcgccaatggtggcgcgtaacgagcgtctcagcggctatgccggtagcgccggggtggcaaaagtccagaaactctccgatatcagccttgaagagctgccgcgtttttccaccggatttaaagagttcgaccgcgtactaggcggcggcgtggtgccaggaagtgccattctgattggcggtaaccctggtgcggggaaatccacgctgctactgcaaacgctgtgcaaactggcccagcagatgaaaacgctgtatgtcaccggcgaagagtcgctgcaacaggtggcaatgcgcgctcatcgccttggcctgccgactgacaatctcaatatgttgtcggaaaccagcatcgaacagatctgcctgattgccgaagaagagcaaccgaagctgatggtaattgactcgatccaggtgatgcatatggcggatgtacagtcatcgcctggtagcgtggcgcaggtgcgtgaaacggcggcttatttgacacgcttcgccaaaacgcgcggtgtggcgattgtcatggtggggcacgtaaccaaagatggttcgctggctggcccgaaagtgctggaacactgtatcgactgttcggtgcttttggatggcgatgccgactcccgttttcgcaccttgcgcagccataaaaaccgcttcggcgcggtgaatgagctgggcgtcttcgcgatgaccgaacaggggctgcgtgaagtcagcaacccttcggcaattttcttaagtcgcggcgatgaagtgacctccggtagctcagtgatggtggtatgggaaggaacgcgtccactgctggtggagattcaggcgctggtcgatcactcgatgatggcgaacccacgccgcgtggcagtggggctggaacaaaaccgtctggcaatcctgctggctgtgttgcaccgtcacggtggtctgcaaatggccgatcaggatgtgtttgtgaacgtggtcggcggcgtgaaggtaaccgaaaccagtgccgacttagcgttactgctggcgatggtttccagcctgcgcgacagaccgctgccgcaggatctggtggtgtttggtgaagtcgggctggcaggggagatccgcccggtgcccagcggtcaggaacgaatctctgaagcggcgaaacacggttttcgccgggcgattgttccggcggctaacgtgccgaaaaaagcgccggaagggatgcagatttttggcgttaaaaaactctccgacgcgcttagcgtgttcgacgacttataatgagatatacggagggagatatgtcgtcatttgattacctgaaaactgccatcaagcaacagggctgcacgctacagcaggtagctgatgccagcggtatgaccaaagggtatttaagccagttactgaatgccaaaatcaaaagccccagcgcgcaaaagctggaggcgttgcaccgttttttggggcttgagtttccccggcagaagaaaacgatcggtgtcgtattcggtaagttctacccactgcataccggacatatctaccttatccagcgcgcctgtagccaggttgacgagctgcatatcattatgggttttgacgatacccgtgaccgcgcgttgttcgaagacagtgccatgtcgcagcagccgaccgtgccggatcgtctgcgttggttattgcaaacttttaaatatcagaaaaatattcgcattcatgctttcaacgaagagggcatggagccgtatccgcacggctgggatgtgtggagcaacggcatcaaaaagtttatggctgaaaaagggatccagccggatctgatctacacctcggaagaagccgatgcgccacagtatatggaacatctggggatcgagacggtgctggtcgatccgaaacgtacctttatgagtatcagcggtgcgcagatccgcgaaaacccgttccgctactgggaatatattcctaccgaagtgaagccgttttttgtgcgtaccgtggcgatccttggcggcgagtcgagcggtaaatccaccctggtaaacaaacttgccaatatcttcaacaccaccagtgcgtgggaatatggccgcgattatgtcttttcacacctcggcggtgatgagatcgcattgcagtattctgactacgataaaatcgcgctgggccacgctcaatacattgattttgcggtgaaatatgccaataaagtggcatttatcgataccgattttgtcaccactcaggcgttctgcaaaaagtacgaagggcgggaacatccgttcgtgcaggcgctgattgatgaataccgtttcgatctggtgatcctgctggagaacaacacgccgtgggtggcggatggtttacgcagcctcggcagttcggtggatcgcaaagagttccagaacttgctggtggagatgctcgaagagaacaatatcgaatttgtgcgggttgaagaggaagattacgacagtcgtttcctgcgctgcgtggaactggtgcgggagatgatgggggagcagagataaccgtgatgaaactgctcaaaggcgaggtataaaatgagtttttttgatgagttgaaaacctctctggaagaggctgtcgagattaaacaaggtttgaaaaaacctgcacgggtgacccgccacgaaattgaggatgctaaggctgttgtagaccggaaacggtgttcacgccgcatccggcattcggtgctcaatgcctgatgcgacgcttaccgcgtcttatcaggcctacagttttacaacgtattgaaattgctggttttgtaggccggataaggcgttcgcgccgcatccggcattttacgcattacttcgcaatacgcttgtacttgatacgcttcggctccagcgcgtctgcgcccagcgtgcgtttcttgtactcttcgtactcggtaaagttaccttcgaagaactcaactttaccttcatcctggtaatccagaatgtgcgtggcgatacggtcgaggaaccaacggtcgtgcgagataaccatcgcacagcccgggaactccagcagggcgttttccagcgcgcgcagggtttcgatatccaggtcgttggttggttcgtcgagcagcagcatgttgccgccaacctgcagcagcttcgccagatgcagacgaccgcgctcaccaccggagagttcaccaacgcgtttaccctgatcaacccctttaaagttaaagcggccaacgtaggcgcggcttggcatctcggtgttgccgatcttcatgatatccagcccgccggaaacttcttcccaaacggttttgctgttatccattgagtcacggaactgatcaaccgacgccagtttcaccgtttcacccaaagtgatggtgccgctgtccggctgttcctgaccagagatcatacggaacagggtcgatttacccgcaccgttcggaccgatgatcccgacgatcgctcctttcgggatcgagaagctcaggtcatcaatcagcagacgatcgccataggatttacgcaggttgctgacttccagcactttatcgcccagacgcggtccaggtggaataaacagttcgttggtttcgttacgtttctgatattcggtgctgttcagttcttcaaagcgcgccagacgtgctttacctttcgactgacggcctttagtaccttgacgtacccattccagctctttctcaatcgacttacgacgcgccgcttcttgtgaagcttcctgcgccaggcgctgatctttctgctccagccaggaggagtagttaccttcccacggaataccttcaccgcggtcaagttcgaggatccagcctgcaacgttatcgaggaagtaacggtcgtgggtaatcgccacaacggtgccttcgaagtcgtgcaggaagcgttccagccaggccacggattcggcatccaggtggttggtcggttcgtcgagcagcagcatgtctggtttttccagcagcaggcggcacaacgctacgcgacgacgttcaccaccggagaggttagcgattttcgcgtcccagtccggcagacgtagcgcatccgccgcacgctccagctgtacgttcagattatgaccgtcgtgagcctgaatgatctcttccagacggccttgttcagcggccagcttgtcaaaatcggcatccggatcggcgtacagcgcatacacttcatccaggcgtttcagggcgttaaccacttctgaaaccgcttcttcaatggactcacgcacggtgtgttccgggttcagctgcggttcctgcggcagataaccaatcttgatgtctggctgcggacgcgcttcaccttcgatgtctttatcaatgcccgccataatgcgcagcagggtggacttacccgcgccattcagacccaggacaccaatttttgccccagggaagaaactcagagagatgtttttcaaaatatgacgtttcggcggaacaactttgccgacacgatgcatggtataaacgaattgagccacgttggacttcgcctctatgtttatcgtgataatgagttttcaaaggcgaagtgtagcctttttccccgcctaatcccagccggtcgatcaccctcgcagtaaaagtaaaaaagtgtccgtaacgtggcgtaaacggcaatgactggttagcataaatctattacgcggcatgacgctgcattgatgtatttacacttagaggatgcgcttgtggaaaaagccaaacaagttacctggcggctgttggctgccggtgtctgtctgctgacggtcagcagcgtggcgcgagccgactcactggatgagcagcgtagtcgttacgcgcaaatcaagcaggcctgggataatcgacaaatggatgtggtcgaacaaatgatgcctggactgaaggattatccgctttatccctacctggaataccgccagatcaccgatgatctgatgaatcaaccggcggtgacggtcactaactttgttcgcgctaaccccacgcttcctcccgctcgcacgctgcaatctcgtttcgtcaatgaactggcgcggcgtgaagactggcgtggcttgttagcctttagcccggaaaagcccggaactaccgaagcgcaatgtaattactactatgcgaaatggaacaccgggcagagtgaagaagcctggcaaggggcgaaagagctgtggctaaccggcaagagccagcctaacgcctgtgacaagttatttagcgtctggcgtgcgtcaggtaaacaagatccgctggcgtatttagagcgtatccgtctggcgatgaaagcgggtaacacaggcctggtaacagtgctggcagggcagatgcctgccgattaccagactatcgcctcggcaatcatttcactggcgaacaaccctaatacggtactgaccttcgcgcgtacaactggcgcgaccgattttacccgtcaaatggcggcggtggcgtttgccagtgtggcgcggcaggatgctgagaatgcacggctgatgatcccatcgcttgcccaggcgcagcagcttaatgaagatcagattcaggagctgcgcgatatcgtcgcctggcgtttgatgggcaacgatgtcaccgacgagcaggcgaaatggcgcgatgacgccattatgcgctcgcaatctacttcgcttattgaacgccgtgtacgaatggcgcttggcaccggcgatcgtcgcggcctgaatacctggctggcgcgtctgcctatggaagcgaaagagaaagatgaatggcgttactggcaggcggatttattgctggaacgcggacgtgaagctgaagcaaaagagattttgcatcaactcatgcaacagcgtggtttctacccgatggttgcagcacaacgcatcggcgaagagtatgagctgaagattgataaagcgccgcagaatgttgacagcgccctgactcaggggccggagatggcgcgcgtgcgcgagttgatgtactggaatctcgataataccgcgcgtagcgagtgggccaatctggtgaagagcaagtcaaaaacagagcaggctcaactggcgcggtatgctttcaacaaccaatggtgggatcttagcgttcaggcaacgatcgccgggaagctgtgggatcatctggaagagcgattcccgctggcttacaacgatcttttcaaacgctacaccagcggtaaggagatcccgcaaagctatgcgatggcgattgctcgtcaggagagcgcctggaatccgaaagtgaaatcaccggtaggggccagcggcttgatgcagattatgcctggtacagcgacccatacggtgaagatgttctctattcccggttatagcagtcctgggcaattgctggatccggaaacgaatatcaacattggcaccagttacctgcaatatgtttatcagcagtttggcaataatcgtattttctcctcagcagcttataacgccggaccagggcgggtgcgaacctggcttggcaacagcgccgggcgtatcgacgcagtggcatttgtcgagagtattccattctccgagacgcgcggttatgtgaagaacgtgctggcttatgacgcttactaccgctatttcatgggggataaaccgacgttgatgagcgccacggaatggggacgtcgttactgatccgcacgtttatgatatgctatcgtactctttagcgagtacaaccgggggaggcattttgcttcccccgctaacaatggcgacatattatggcccaacaatcaccctattcagcagcgatggcagaacagcgtcaccaggagtggttacgttttgtcgacctgcttaagaatgcctaccaaaacgatctccatttaccgttgttaaacctgatgctgacgccagatgagcgcgaagcgttggggactcgcgtgcgtattgtcgaagagctgttgcgcggcgaaatgagccagcgtgagttaaaaaatgaactcggcgcaggcatcgcgacgattacgcgtggatctaacagcctgaaagccgcgcccgtcgagctgcgccagtggctggaagaggtgttgctgaaaagcgattgattttgtaggcctgataagacgtggcgcatcaggcatcgtgcaccgaatgccggatgcggcgtgaacgccttatccgtcctacaaatacccgtaatttcaatatgtttggtaggcatgataagacgcggcagcgtcgcatcaggcgcttaatacacggcattatgaaacggactcagcgccaggatcaccgcctggtgatagacgctggcgcgagtgagtttcccggcggtaaacacgccgatcgccccttccttacgaccaatctcatcaataccggtataacgcgacatcacgggaccaagcgcctcaccttcacgcactttttccagaatcaccgcaggcaacggcaaagtagccgaacgcgcctcgccgcgctggctggcgttttcaatcaccacccaactgaaagtgctgtcaccatcgatgccagcttcaatcgccacccaaaaatcagcctctggaagtaaacggcgggcattggctacccgatttcgtgcgccagcgcgcgtttcctcactgccaaagggctgttccggtacaccgctctcgacggcaacggatgcaatatggcaggatccttcgccgaagatctcgtgaaatgcctgcagaatggcctgaattttagcgggattggtggtcgcacagacaacttggtgcataatcagcattactcagaaaattaacgttacagcagtatacggaaaaaaagcatgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacgcacccggcgtacggcggaaatcatcgcccaggcctgcggctgtgacatcatctttgattctcgcctgcgtgaattaaacatgggtgtgctggaaaaaagacatatcgattctctgaccgaagaagaagagaactggcgtcggcagctggtcaatggcaccgttgacgggcgtattcctgaaggcgagtcaatgcaggagctcagcgatcgcgtcaatgcggcactggaatcttgccgggacttaccgcagggaagccgaccgctgctggtgagtcatggtattgcactgggatgcctggtgagtacgattctcggattaccagcatgggcagagcgccgcttacgtctgcgtaactgttctatttcgcgcgtggattatcaggaaagcctgtggctggcgtctggctgggtcgttgaaaccgcaggggacatctcgcatctggacgcccctgcattagatgagctgcagcgttaacgacggatcggaatcagcagttcacagcgtagattaattgggcgatctcccgctttggcatcttctgccgggtagtatcgctcaatatcctgacctttacggcgcgtcaggttgagcattggcatgcacgttccgtataccgtcaggataaactcctgcacgccggttcccagaccttcataggtaaacatcacatattcgccgccctgcagcatcaccggatgccccgtcagtacatagccatctgcctgatcctgggctaacgcggtggtatagaatacctcttgctcgtcgtctttatcctgactcggacgcgtttcattcaggccgtagagcaccggcggaatggtcggcgcgttgccgagaaaatcgtgccagaactgataacgcatttcatggcggaaatcagagatttgctccagcgaacaggagtagctctgggtaacaccaatcagcggcgtatcttccagggtgacaaatttgtgctctggcatagtgaattcacccaggcgtagcggcgggcgaataccaaaggcgctccattcaggagaacggcggtaaagtgcaggagtctgggcaaactgcttcttgaatgcgcgggtaaatgtctgttgagagtcgaagcggtattgcagcgcgatgtccagaatcggacgcgcagtcaggcgtagtgcgaccgccgatttcgacaaacgacgagcacgaatatacgcgccaatagcatggccagtgacatctttaaacattctctgtaagtgccacttggaataacctgctttcgccgctacattgtcgagcgacaggggctgatccagatgaccttccagccagattaaaaggtcgcgaataatgccggcctgatccataaaatatcctcatcctttcaacaacgagcacctgacatcaggtaattggataatagcattttttgctgttttagcattcagtgtttttttcttagtagagtatgttttagggcttgacggaaataaaagtattgagattttgttcttaatcaatatgttatttaccgtgacgaactaattgctcgtgtaatagataaaaatggtaacaatatgaaatacaagcatttgatcctgtctttaagcctgataatgctggggccattggctcatgcagaagagattggttcggtcgacaccgtatttaaaatgatcggcccggatcacaaaattgttgtggaagcctttgatgatcccgatgtgaaaaatgtcacctgttatgtgagccgggcgaaaaccggtggtattaaagggggattgggtctggcggaagatacctccgatgcggccatttcttgtcagcaagtcgggccgattgaactgtcggatcgtattaaaaacggcaaagctcagggcgaggtagtattcaaaaaacgcacgtccctggtctttaagtcgttacaggtcgtgcgcttttatgatgccaaacgcaacgcgctcgcttatctggcttactccgacaaagttgtagaaggttcgccgaaaaacgcgattagcgcggttcctgtcatgccgtggcggcaataacagaggcgatttatgcaacgggaaacggtctggttagtggaagatgagcaagggatagccgacacgctggtctacatgttgcagcaggaaggttttgccgtcgaggtctttgagcgaggcttgccggtgctggataaagctcgcaagcaggtacccgacgtcatgattctcgatgttggtctgccggatattagcggctttgaattgtgccgccagttactggcgctccatccggcgttacctgtactgttcctgacggcccgaagtgaagaggtcgatcgcctgcttgggctggaaattggtgctgacgactacgtggctaaaccgttttcaccccgcgaagtgtgcgccagggtgcgcaccttactgcgtcgggtgaagaagttctcgacgccgtctcccgtcatccgtattggacattttgaattgaatgaacccgcggcgcagatcagctggtttgacacgccattagcgctgactcggtatgagtttttattgttgaagacgttactcaagtcaccgggccgcgtctggtcccgccagcaactgatggatagcgtatgggaagatgcgcaggacacctacgatcgcaccgtcgatacccacattaaaacgctgcgtgccaagctgcgcgccatcaaccccgatctttcaccgattaatactcatcgcggcatgggatatagcctgaggggcctgtaatgcgtatcggcatgcggttgttgctgggctattttttactggtggcggtggcagcctggttcgtactggccatttttgtcaaagaagttaaaccgggcgtgcgaagagcaacggaggggacgttgatcgacaccgcaacgttgctggcggagctggcgcgtcccgatttgctctctggggacccaacgcatgggcaactggcgcaggcgtttaatcagctacaacatcgcccgtttcgcgccaatatcggtggcattaacaaagtgcgcaatgaatatcatgtctatatgaccgatgcgcagggcaaagtattgttcgattcggcaaataaagccgttggacaggattattcgcgctggaatgacgtctggctaacgttgcgtggtcagtatggtgcgcgcagcacgttgcaaaatcctgccgatcccgaaagttctgtgatgtatgttgccgcaccgattatggacggctcgcggcttattggcgttttgagcgtaggcaaaccgaacgcggcgatggctccggtcattaagcgtagcgagcggcgaattttatgggccagcgccattttgttggggattgcactggtgattggcgcaggcatggtttggtggatcaaccgctctattgcccggctcactcgctatgctgattccgtcactgacaataagcccgttcctctccccgatctcggtagtagcgagttgcgtaaactcgcgcaggcgctggaaagtatgcgcgtgaagctggaagggaaaaactatattgagcagtatgtttacgcattaactcatgagctaaaaagcccactggcggcgattcgtggagcggcggaaattttacgcgaaggtccgccgccggaagtggtggctcgttttactgacaacattctgacgcaaaatgcgcgtatgcaggcattggtagaaacgttactacgccaggcaagactggagaatcgtcaggaagtcgttctgactgctgttgatgtggcggcattattccgccgcgtcagcgaagcgcgcaccgtgcagttggcagaaaaaaaaatcactctgcatgttacgcccaccgaggttaacgttgctgctgaaccggcgttactggagcaggcgctgggaaatttactggataacgccatcgattttacccccgagagcggttgcatcacgctaagcgccgaagtggatcaggaacacgtcacgcttaaggtgctggataccggtagtggtattcctgactacgcgctttcacgtatttttgaacgcttttactctttgcctcgtgcaaatgggcaaaaaagcagcggtctggggttggcgttcgtcagtgaggtcgcccgtttgtttaacggcgaagtcacgctgcgcaacgtgcaggaaggtggcgtgctggcctcgcttcgacttcaccgtcacttcacatagcttcaaattcttcccacatagtcttcgtatcctgctgccattgcaaaggagaagactatgttgaaatcccccctgttctggaaaatgactagcctgtttggtgcagtattgctgttgttgattccgataatgctgattcggcaggtgattgtcgaacgtgctgattaccgtagcgatgtggaagatgcgattcgccaaagtaccagcgggccgcaaaaactcgttgggccgctcatcgctattcctgtgaccgagctttatacggtgcaggaagaggataaaaccgtggagcggaaacgaagttttatccatttttggttacctgagtcattgatggttgatggcaatcagaacgtggaagaacgcaagatagggatttataccggtcaggtctggcacagtgatttaacgttaaaagccgatttcgatgtttcgcgtcttagcgaactcaacgcgccaaatatcaccttaggcaagccatttattgtgattagcgtcggggatgcgcgtggtattggtgtggtgaaagcgcctgaagttaacggaacggcgctgaccattgaacccggcaccgggttagagcaaggcgggcagggcgtgcatatccctttacctgaaggggactggcggaagcagaacctgaagctgaatatggccctgaatttaagcggtaccggcgatctttctgtggtgcctggcgggcgtaatagcgaaatgaccttaaccagcaactggccgcatcccagttttttaggtgattttctaccagccaaacgggaagttagcgagtcaggttttcaggcgcactggcaaagcagctggtttgctaataatctcggtgagcgttttgcttcaggcaatgataccggctgggaaaacttcccggcgtttagcgtcgcagtaacgacgccagccgatcaataccaattaactgaccgggcgactaagtacgccattctgctgattgcactgacttttatggcgttctttgtttttgaaacgctcaccgcgcaacgtttacacccaatgcaatatttgctggtggggctttcattggtgatgttttatttgctcttgctggcgctttctgaacataccggttttaccgtggcatggataatcgccagtctgattggggcgataatgaacggtatttatttgcaagcggtattgaaaggttggtgcaacagcatgttgtttaccctcgcgctgttgttgctggatggtgtgatgtggggactgctcaactctgccgatagcgcgctgttgttgggaaccagtgtgctggtggtggcgctggccggcatgatgtttgtgacccgtaatatcgactggtatgcgttttcactgccgaaaatgaaagccagtaaagaagttacaacggacgatgagttacgtatctggaaataaggttgaaaaataaaaacggcgctaaaaagcgccgttttttttgacggtggtaaagccgattaatcttccagatcaccgcagaagcgataaccttcaccgtgaatggtggcgatgatttccggcgtatccggcgtagattcgaaatgtttacgaatacggcggatcgtcacgtctacagtacggtcgtgcggtttcagctcacggccggtcattttcttcagcagttcagcacgggactgaattttgcctgggttttcacagaagtgaagcatggcgcggaactcgctgcgcggcagcttgtactgctcgccatcagggccgatcaacgaacggctgttgatgtccagttcccaaccattgaacttgtagctttcaacgctacgacgttcttcgctgacagtacccagattcatggtacgggacagtaggttgcgtgcacgaatcgtcagttcacgcgggttgaacggtttggtgatgtagtcatctgcaccgatttcgaggccgagaattttatcgacttcgttgtcacggccagtcaggaacatcaacgcaacattcgcctgctcgcgcagttcacgcgctaacagaagaccgttcttacccggcagattgatatccatgatcaccaggttgatgtcatattcagagaggatctgatgcatttccgcgccatctgtcgcttcgaaaacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgctgcaaattaacatgatcggcgtaacatgactaaagtacgtaattgcgttcttgatgcactttccatcaacgtcaacaacatcattagcttggtcgtgggtactttccctcaggacccgacagtgtcaaaaacggctgtcatcctaaccattttaacagcaacataacaggctaagaggggccggacacccaataaaactacgcttcgttgacatatatcaagttcaattgtagcacgttaacagtttgatgaaatcatcgtatctaaatgctagctttcgtcacattattttaataatccaactagttgcatcatacaactaataaacgtggtgaatccaattgtcgagatttattttttataaaattatcctaagtaaacagaaggatatgtagcattttttaacaactcaaccgttagtacagtcaggaaatagtttagccttttttaagctaagtaaagggctttttctgcgacttacgttaagaatttgtaaattcgcaccgcgtaataagttgacagtgatcacccggttcgcggttatttgatcaagaagagtggcaatatgcgtataacgattattctggtcgcacccgccagagcagaaaatattggggcagcggcgcgggcaatgaaaacgatggggtttagcgatctgcggattgtcgatagtcaggcacacctggagccagccacccgctgggtcgcacatggatctggtgatattattgataatattaaagttttcccgacattggctgaatcgttacacgatgtcgatttcactgtcgccaccactgcgcgcagtcgggcgaaatatcattactacgccacgccagttgaactggtgccgctgttagaggaaaaatcttcatggatgagccatgccgcgctggtgtttggtcgcgaagattccgggttgactaacgaagagttagcgttggctgacgttcttactggtgtgccgatggtggcggattatccttcgctcaatctggggcaggcggtgatggtctattgctatcaattagcaacattaatacaacaaccggcgaaaagtgatgcaacggcagaccaacatcaactgcaagctttacgcgaacgagccatgacattgctgacgactctggcagtggcagatgacataaaactggtcgactggttacaacaacgcctggggcttttagagcaacgagacacggcaatgttgcaccgtttgctgcatgatattgaaaaaaatatcaccaaataaaaaacgccttagtaagtatttttc

SEQ ID NO: 2 - DNA, 20 bp, Artificial Sequence
  Synthetic primer
gaaaagtggcggggatcact

SEQ ID NO: 3 - DNA, 20 bp, Artificial Sequence
  Synthetic primer
tacctcaatgtgtatcacaa

SEQ ID NO: 4 - DNA, 20 bp, Artificial Sequence
  Synthetic primer
gccatttttaatatagattg

SEQ ID NO: 5 - DNA, 20 bp, Artificial Sequence
  Synthetic primer
gttctgctgatttaaccgca

SEQ ID NO: 6 - DNA, 20 bp, Artificial Sequence
  Synthetic primer
ggtcatgccaaccgcgacaa

SEQ ID NO: 7 - DNA, 20 bp, Artificial Sequence
  Synthetic primer
ctgattttaattaacgcgcg

SEQ ID NO: 8 - DNA, 20 bp, Artificial Sequence
  Synthetic primer
atagcgggcggcagaaggaa

SEQ ID NO: 9 - DNA, 20 bp, Artificial Sequence
  Synthetic primer
tacgagagtggacggtcccc

SEQ ID NO: 10 - DNA, 20 bp, Artificial Sequence
  Synthetic primer
tccggcattaaaggaaaatc

SEQ ID NO: 11 - DNA, 19 bp, Artificial Sequence
  Synthetic primer
ttaacgttgtgcttcgcca

SEQ ID NO: 12 - DNA, 20 bp, Artificial Sequence
  Synthetic primer
atcctgcagggcgcgccatt

SEQ ID NO: 13 - DNA, 20 bp, Artificial Sequence
  Synthetic primer
ggagtaatccccgcatatcc

SEQ ID NO: 14 - DNA, 20 bp, Artificial Sequence
  Synthetic primer
acgcagatttttttgcccat

SEQ ID NO: 15 - DNA, 20 bp, Artificial Sequence
  Synthetic primer
atatgcccaataaattgtcg

SEQ ID NO: 16 - DNA, 20 bp, Artificial Sequence
  Synthetic primer
ccccggcccttgtttttatc

SEQ ID NO: 17 - DNA, 20 bp, Artificial Sequence
  Synthetic primer
atatgcccaataaattgtcg

SEQ ID NO: 18 - DNA, 20 bp, Artificial Sequence
  Synthetic primer
gttggcggcgggctgatttt

SEQ ID NO: 19 - DNA, 20 bp, Artificial Sequence
  Synthetic primer
caacggcaaaccgattaccg

SEQ ID NO: 20 - DNA, 20 bp, Artificial Sequence
  Synthetic primer
cgttccatggatggaagact

SEQ ID NO: 21 - DNA, 20 bp, Artificial Sequence
  Synthetic primer
ttaagctgatgttaatcgaa

SEQ ID NO: 22 - DNA, 20 bp, Artificial Sequence
  Synthetic primer
gcaacatcagcagccatacc

SEQ ID NO: 23 - DNA, 20 bp, Artificial Sequence
  Synthetic primer
ttatgcagcaacaatgctgt

SEQ ID NO: 24 - DNA, 20 bp, Artificial Sequence
  Synthetic primer
tcacagtgaaacgtaacgta

SEQ ID NO: 25 - DNA, 20 bp, Artificial Sequence
  Synthetic primer
tactgaaaacgggtgaacaa

SEQ ID NO: 26 - DNA, 20 bp, Artificial Sequence
  Synthetic primer
ataacggaaaggcgtgggta

SEQ ID NO: 27 - DNA, 20 bp, Artificial Sequence
  Synthetic primer
aacccccgggcgcgttcctt

SEQ ID NO: 28 - DNA, 20 bp, Artificial Sequence
  Synthetic primer
acgatgcctcaccgacgact

SEQ ID NO: 29 - DNA, 20 bp, Artificial Sequence
  Synthetic primer
tccctgttacgttttaatgt

SEQ ID NO: 30 - DNA, 20 bp, Artificial Sequence
  Synthetic primer
tggtggcgactatgcactag

SEQ ID NO: 31 - DNA, 20 bp, Artificial Sequence
  Synthetic primer
gcagaaactccgtaatgaag

SEQ ID NO: 32 - DNA, 21 bp, Artificial Sequence
  Synthetic primer
catttatatgaaattactgaa

SEQ ID NO: 33 - DNA, 20 bp, Artificial Sequence
  Synthetic primer
gtcattttacccgatagccg

SEQ ID NO: 34 - DNA, 20 bp, Artificial Sequence
  Synthetic primer
tcaacatcatcgtttcgacg

SEQ ID NO: 35 - DNA, 20 bp, Artificial Sequence
  Synthetic primer
ctatttttaatccgactatg

SEQ ID NO: 36 - DNA, 20 bp, Artificial Sequence
  Synthetic primer
gcagaagggcaccccgagtc

SEQ ID NO: 37 - DNA, 20 bp, Artificial Sequence
  Synthetic primer
tgaacgttatccctgtagta

SEQ ID NO: 38 - DNA, 20 bp, Artificial Sequence
  Synthetic primer
gagaaatagtgcaggccgtc

SEQ ID NO: 39 - DNA, 20 bp, Artificial Sequence
  Synthetic primer
gtccggcagataaagactaa

SEQ ID NO: 40 - DNA, 20 bp, Artificial Sequence
  Synthetic primer
aatcaacatggaataaaatc

SEQ ID NO: 41 - DNA, 20 bp, Artificial Sequence
  Synthetic primer
tagtcagtgacgaacatcag

SEQ ID NO: 42 - DNA, 20 bp, Artificial Sequence
  Synthetic primer
aagcgcggggagagttgcgt

SEQ ID NO: 43 - DNA, 20 bp, Artificial Sequence
  Synthetic primer
tccgtcgaggattgcgcttt

SEQ ID NO: 44 - DNA, 20 bp, Artificial Sequence
  Synthetic primer
caagctctgcgggctttttt

SEQ ID NO: 45 - DNA, 20 bp, Artificial Sequence
  Synthetic primer
cctttgaaaacaggacgtaa

SEQ ID NO: 46 - DNA, 20 bp, Artificial Sequence
  Synthetic primer
cgctggcgcggggaacaccc

SEQ ID NO: 47 - DNA, 20 bp, Artificial Sequence
  Synthetic primer
caggttgatagaaatatcgc

SEQ ID NO: 48 - DNA, 20 bp, Artificial Sequence
  Synthetic primer
ctccttgttgctttacgaaa

SEQ ID NO: 49 - DNA, 20 bp, Artificial Sequence
  Synthetic primer
cggaaagggtagcaggccgg

SEQ ID NO: 50 - DNA, 20 bp, Artificial Sequence
  Synthetic primer
ttgcgggtatacctcagttc

SEQ ID NO: 51 - DNA, 20 bp, Artificial Sequence
  Synthetic primer
agattacgccattttgaatt

SEQ ID NO: 52 - DNA, 20 bp, Artificial Sequence
  Synthetic primer
gcgcgcaacgttgccagcac

SEQ ID NO: 53 - DNA, 20 bp, Artificial Sequence
  Synthetic primer
atctgccagcacgtagctgt

SEQ ID NO: 54 - DNA, 20 bp, Artificial Sequence
  Synthetic primer
gtgttgatttccaacgagta

SEQ ID NO: 55 - DNA, 20 bp, Artificial Sequence
  Synthetic primer
aactttgatttatagtcagg

SEQ ID NO: 56 - DNA, 20 bp, Artificial Sequence
  Synthetic primer
aaaacgctgctatgatttaa

SEQ ID NO: 57 - DNA, 20 bp, Artificial Sequence
  Synthetic primer
aaaattcttatcgataccgt

SEQ ID NO: 58 - DNA, 20 bp, Artificial Sequence
  Synthetic primer
ctcaggtcgaaatctaacgc

SEQ ID NO: 59 - DNA, 20 bp, Artificial Sequence
  Synthetic primer
cagacgcctcctttcttcat

SEQ ID NO: 60 - DNA, 20 bp, Artificial Sequence
  Synthetic primer
tttttttatgcctgaaatcc

SEQ ID NO: 61 - DNA, 20 bp, Artificial Sequence
  Synthetic primer
taaggcgagattattaaagt
